United States Patent 7,745,391 (HUMAN THROMBOSPONDIN POLYPEPTIDE) - sequence listing, part 187

SEQ ID NO: 451973 - DNA, 2525 bp, Homo sapiens
cggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagaagaaaaagaaacagaaaccagcacaggatgtacctggcaaagattcatatctgcctgcagctcactttcagatggcttggggaaaaaagtgtgtgttgggagagagaagagatggagagagcgagcacaaatgtgccaaaatgttgcttgaaaacagacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaatagtgtctcttcaaggttttacttgatttaatttgatattttactggtttaccagtaaggtgtattgttcagttttttgctccgatttgaattgtggaggtggaagcaaattagtttacatggcatgtcctccctaggcacagtgacagctgtaaagtatgacggaacaaggtagcagatggtacagaatttatactatttaaga

SEQ ID NO: 451974 - DNA, 3696 bp, Homo sapiens
  misc_feature (1105)..(1105): n is a, c, g, or t
  misc_feature (1123)..(1123): n is a, c, g, or t
  misc_feature (1310)..(1310): n is a, c, g, or t
tgggattgcaggtgtgagctaccgtgtctggcctccatgttacttctacatgagaattgatctggggaggaagaagggttctcaggcttgggcaaccactgatatagttcagctctctaatttcactgatgtgaggaaaggattcagagaattcaagtgacttcttcacagctgcagaatggcagggctaagatagatacattatacccagcaccctccccacaccactctgctgtcccctggatccagggcctttatgctggcagctcctctgttgcttctctggagtggtgtggacactggccacctactgagaagtgtttttttaaaaaatgtgtgtgtgtgtgtgtgtgtgtgtgtatagtatttttaaaaaataaaggtcttagatatcagcttcagagatgtaactgtctttcataatataagtgatgtttgccaggaatattatcctaaatttgttagacatatttctgacatatctgtgatgatagtttgaaaattagtatgtattatttgttgccttttatgccattgtgtccttttcttgatgttttcaaagctggctgaatcctacacaatatgttacactcctaatctgcattttttaaatgcataggccgtttaacttagcacagactattggcctctgcttgaagaatagtatacctataaactggaagcattatcatcacttactcattataacccatcctgtctgttctgtacagtatagttggacccagatttttaccctatgaatttggttagcacaaatgggggaaagtatgaaatgccaaggaaaattgaaattcatgtaggagatgagtagaggaatgttcaggagttcaagcagaacaagaggaacccaactataccgtttctgatctaaatggtatggtggggaaaaaccatcagatcaacagaaaggacataatttttaaataaaagtaacttccttatattgagcaaatttaattttatgaaaaatgcattacaaagtctttgtttcactcatttctctgtgcgactattgaagtgtttgttaaactggatcacgtccaagaagttaatgttaggccaggcagggtggctcacgcttatnttcccagcactttggaangccaaggcgggtggatcacgaggtcaggagttcgagaccatcctggccaatatggtaaaaccctgtctctactaaaaaatacaaaaattagctgagtatggtggcacgtgcctgtaatcccagctattcgggaggctgaagcaggaaaatcgcttgaacccgggaggcagaggttgcagtgagccangatcgcgccactgcactcgagcctgggtgacagagtgagactccatctcaaaaaaaaagttaatgtttttggggaaccacacttcatgtcagatcatttatgattaccgttggttagttttgaagatggtttgctcctttaaatggagtattaagtgctttgtgcttttttttttccccctgaaacagtcttactctgtcaccccagctagaatgcagtggtgcaatcttggctcactgcagtctccacctcctgggttcaagtgattcccctgctcctcctcctaagtaactgggattgcaggtgcctgccaccacgctcagctaattttttatatttttaatagaggcggaggtttcaccatgttggccaagctggtctcgagctcctgacctcaagtgatctccccgccttggcctcccaaagtgctgggattacaggtgtgagccaccgtgcctggcagtgtttttatgaaaacactgtataaaacattctgtataaaacactgtattaaacactgtataaaacatttatctctgtataaaacattcagagatattttaaggaccttgttttaactttgtttcaactgttttaaggaaattccttaatttttgtgccaaatttgatattcaatttgatttctgaagttgctttttaaagatgttcatttaagatgtaaagattatttaaattgcctttaaaattaatgaattaacttttaaagtgcagttcatttttttgagtgttctagagagcactcaaataatgatggttaaaaggagtatgttatttttggattatgctgaattatttattttccagtgttcctaaacccaaaggaaagaaaaccaaagatatgaaaaaacctgtcagagtacctgctgaaccacaaacaatggtaggtcaaaatcatattcatatctctttagcatatcttgctgtttaagcagtataatgatctaaagatggaaatgtgtatttggtgagccattccgcaaagagcctgcaaagatgtggatccatcaacagttttgtttgatataatgtatctttttttttcattaaaataaaaagaagcacattggaaatgctagactgtaccagaacagttactgttgttttctattacttttcaatctaaagccttggtgataagaattacatgtgtcaagttctggagattaattgtgaagcataaactcttcctcttttttagtccatgaggtacatgctattgaaagtctcaggacccttaaagttaatcgtgttgattagtgggatttaacctccaagaacatctgcctttgttgaacgtgtttattacctgtccactctgttaaaacatctttattttacaattgtttgatgcttaatcttgatattaaaacctaaaacactactttcaagtgataacgcttacttttatttatgattttttgcccttctcagagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaatagtgtctcttcaaggttttacttgatttaatttgatattttactggtttaccagtaaggtgtattgttcagttttttgctccgatttgaattgtggaggtggaagcaaattagtttacatggcatgtcctccctaggcacagtgacagctgtaaagtatgacggaacaaggtagcagatggtacagaatttatactatttaaga

SEQ ID NO: 451975 - DNA, 2174 bp, Homo sapiens
cggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaaggtaatttagatgtatctgtacatatttatgtatagatacacacacacatatgtatacagatgaagagcgttgagaagaggatgctagaggaatgtgcccacacacatctcagcagcatggccaaaatcagaaagatgtcactttgatccagttcttgtttaccttatcctgctgtggcgctgattttgtcgtggatcattaacacttgacactcacatgagaacaagactcctgctgcgtccctggagtgtcactaagcaaatctccatgctcacgacagcagcctgtgttgggccccaccatgttgtgaggacacatggcagcagctggggcccttcctgctcagaggagccctggactcttggtgctgcacaaggccatggtgtggactaggaggaggtctcacccaagggaggtagccagtcctgttctctccttcctcctcttgtctgactttcttttccccatcctcctcggttcctctagaacagagaatcatttcatatttcttgaggaaagatctgatagtgaggagcttcaagtttctgtcattacagaaccctgaaaagaattaaagtgagagagcaaagtgggagcatgaagtgaaaatgctaacactggagcaacagtgatggggtggggagtgtgtgtacttcggagtttaaggcacttagtagtaggaaggaggaaacagatgtgggtgagacctacagtatgactctggctatagaaaaaggtatataaagaactacacaaactggtaatgttgaagctttgaagaactttggagagtt

SEQ ID NO: 451976 - DNA, 453 bp, Homo sapiens
ttatttactaatcaccatggtcccatctagtgattagtaaggctatttttattttctcattaagtttattttgaagagtgattttttctggaaagccttaaaagtactgtcttctccagagattattagaagtgttatatacatgaaaaaagaaaggtaaaagatgtttcgcatcagtaatatttactgcttttctaaaaaaaaatcttaaagcgcagaagttaatctgttttctttgtcactaggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaa

SEQ ID NO: 451977 - DNA, 626 bp, Homo sapiens
cggcacatatgttttattacctagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaaggtaagtcaaagttgcatattatttgtaaattactgaatattgatagtaaggatgtagcttttcatatatcaaataaaatcttctttcccatgactgaccaggtaatttagatgtatctgtacatatttatgtatagatacacacacacatatgtatacagatgaagagcgttgagaagaggatgctagaggaatgtgcccacacacatctcagcagcatggccaaaatcagaaagatgtcactttgatccagttcttgtttaccttatcctgctgtggcgctgattttgtcgtggatcattaacacttgacactcacatgagaacaagactcctgctgcgtccctggagtgtcactaagcaaatctccatgctcacgacagcagcctgtgttgggccccaccatgttgtgaggacacatggcagcagct

SEQ ID NO: 451978 - DNA, 2390 bp, Homo sapiens
cggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaatagtgtctcttcaaggttttacttgatttaatttgatattttactggtttaccagtaaggtgtattgttcagttttttgctccgatttgaattgtggaggtggaagcaaattagtttacatggcatgtcctccctaggcacagtgacagctgtaaagtatgacggaacaaggtagcagatggtacagaatttatactatttaaga

SEQ ID NO: 451979 - DNA, 1910 bp, Homo sapiens
cggccgcccgcccggtcgggcgatgaagtgtcactatgaggcgctgggggtgcggcgcgacgccagcgaggaggagctcaagaaggcctatcggaagctggccctgaaatggcacccggataaaaatctggataatgccgcagaagcagctgaacaatttaaattaatccaagcagcatatgatgtgttgagtgaccctcaggaaagagcatggtatgataatcatagagaggccctacttaaaggtgggtttgatggcgaatatcaagatgacagcttagatttgctacgctatttcaccgttacctgttattctggttatggagatgatgaaaagggattttacacggtgtatcgtaatgtttttgaaatgattgccaaggaagaactagaatctgtgttagaggaagaggttgatgatttcccaacttttggagactcccagagtgactatgatacggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaaagacagtgatgaggccgaggacgctgagctctatgatgacctttactgcccagcatgtgacaaatcgttcaagacagaaaaggccatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagctttctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatacttgtccccaaaaactttccttttttctacttacccctattaaaaacttaaaaag

SEQ ID NO: 451980 - DNA, 478 bp, Homo sapiens
cgcggatcattatatctgcagcccgagttcgaagagacagacgggagaggctctagttatgctccaaataaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtga

SEQ ID NO: 451981 - DNA, 663 bp, Homo sapiens
gtatgaaaatgagctcacccttcaccaaaacgtagaggccgacatcaacggattacggcgagtcctggacgagctgacgctctgcaggaccgaccaggagctgcaatatgagtctctgagtgaggagatgacatatctcaaaaagaaccacgaagaggagatgaaggctctgcagtgcgcggctgggggcaacgtgaacgtggagatgaacgcggccccgggggtagacctcgcggttttgttgaacaacatgcgagcggagtacgaagcccttgcagagcagaaccgcaaggacgcggaggcctggttcaatgagaagagcgcctcgctgcagcaacagatctcccacgactcaggcgcagccactttcgcccggagccagctcaccgagatgaggcgcaccctgcagaccctggagatccagctgcagtccctgatggccacgaaacactccctggagtgctccttgacggagaccgagagcaactactgtacgcagctggcgcagatccaggctcagatcggggccctggaggagcagctgcaccaggtcagaaccgagaccgagggccagaagctggagtatgagcatctcctcgatgtcaaggtccacttggaaaaagaaattgagacctactgccgcctgatagatggagatggaaa

SEQ ID NO: 451982 - DNA, 875 bp, Homo sapiens
cgcggatcattatatctgcagcccgagttcgaagagacagacgggagaggctctagttatgctccaaataaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtgatttttttctatgtctcattcatagagaaacacttgtggaatatattttaattgcctttcactgttgttttaaataatagtcaataccgccacatggcatttgaatatgaaacattcactatgcataatctttaaatcacatcgtgtctatgtgggcaaataatcaaaaacttcagaaattctcctgtgactgaaaagtctcaccactagatgacgcattcctggtattttaccaagagcctctctcaaactcttctttcacaatacccaggataccattcctcgtctaaacaggataatctccggaaaaatccacagcaatatggcttgtgttagtgacacttttcctagaacaggggtcagaagctttttttggaaaacccagatagtaaatattt

SEQ ID NO: 451983 - DNA, 874 bp, Homo sapiens
gtaacatatgtaatatgctgctcacttcatagacaggagaaagagagagggctagttatgctccaaataaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtgatttttttctatgtctcattcatagagaaacacttgtggaatatattttaattgcctttcactgttgttttaaataatagtcaataccgccacatggcatttgaatatgaaacattcactatgcataatctttaaatcacatcgtgtctatgtgggcaaataatcaaaaacttcagaaattctcctgtgactgaaaagtctcaccactagatgacgcattcctggtattttaccaagagcctctctcaaactcttctttcacaatacccaggataccattcctcgtctaaacaggataatctccggaaaaatccacagcaatatggcttgtgttagtgacacttttcctagaacaggggtcagaagctttttttggaaaacccagatagtaaatattt

SEQ ID NO: 451984 - DNA, 861 bp, Homo sapiens
taagcagaaatataaaagaataaactatatttcttttacaagttatgctccaaataaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtgatttttttctatgtctcattcatagagaaacacttgtggaatatattttaattgcctttcactgttgttttaaataatagtcaataccgccacatggcatttgaatatgaaacattcactatgcataatctttaaatcacatcgtgtctatgtgggcaaataatcaaaaacttcagaaattctcctgtgactgaaaagtctcaccactagatgacgcattcctggtattttaccaagagcctctctcaaactcttctttcacaatacccaggataccattcctcgtctaaacaggataatctccggaaaaatccacagcaatatggcttgtgttagtgacacttttcctagaacaggggtcagaagctttttttggaaaacccagatagtaaatattt

SEQ ID NO: 451985 - DNA, 520 bp, Homo sapiens
cgcggatcattatatctgcagcccgagttcgaagagacagacgggagaggctctagttatgctccaaataaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtgaaaaaaaaaaaaattgggacctctttggactcaagggggggag

SEQ ID NO: 451986 - DNA, 866 bp, Homo sapiens
  misc_feature (17)..(17): n is a, c, g, or t
  misc_feature (26)..(26): n is a, c, g, or t
  misc_feature (28)..(28): n is a, c, g, or t
  misc_feature (30)..(31): n is a, c, g, or t
  misc_feature (35)..(35): n is a, c, g, or t
  misc_feature (55)..(56): n is a, c, g, or t
gcacctctctcgccccnccccccccncncnnccancacaaaagccctagttctgnnccaaacaaagtctttggatcagcagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtgatttttttctatgtctcattcatagagaaacacttgtggaatatattttaattgcctttcactgttgttttaaataatagtcaataccgccacatggcatttgaatatgaaacattcactatgcataatctttaaatcacatcgtgtctatgtgggcaaataatcaaaaacttcagaaattctcctgtgactgaaaagtctcaccactagatgacgcattcctggtattttaccaagagcctctctcaaactcttctttcacaatacccaggataccattcctcgtctaaacaggataatctccggaaaaatccacagcaatatggcttgtgttagtgacacttttcctagaacaggggtcagaagctttttttggaaaacccagatagtaaatattt

SEQ ID NO: 451987 - DNA, 1837 bp, Homo sapiens
cagttttaggttcacagagatttcccatatcctccccactatcaacatcctcaccagagtggtacatttgttgaaactgatgaatctacattgacacatcatcacccaaagtccgtagtttacattagggttcattttaccactttttctttctctatctgttcatctggaaacatactttgttttctctctatttagacaggtatggataaggtatatgtagacatactttttccccaaatcctttgacggtaaattgcagatatcctgacaattcaccactaactactataactgcatctcctaaaaacggataccatccttcatgattacagtattgttaccatgtttagagaattaataatcatcctgtaatatcatctgatatccagctcatacgcaaattgcatggaaaaatttgtgtgtgtgtggttgactaatagccatcttttggcatgctctttgttttagaacttaaaaggaagtttcaattacaaaactaatacatgctcattgaaaaaggtctaaaagagaaagtaaaatcgcctgtcaccctcccccctacttgtgccctgtgcctgttcagtgggactcctctgtctgctctgggcctctccgagaggccctgccagtgctgcacagcctgtgacctcctctgtccaggaaagtggctgcatctaacgcacaccctcttccctccagcaccagcagcaggtggcgcaggcagtggagcgcgccaagcaggtcaccatgacggagctgaacgccatcatcggggtacgtggactccccaatctgcctcttaccgtgtgtatagcccttttattcctctcatttatcataaccagagattgaccctgaccttagctggcctcaaagaatggcggccccagggctccggcttctacaagcaccccaagggcttggacccatgtagggctgtttcccccttggctcccagttgcctcctagtcctcaaactaaaggggagccagacacgcctcaaatccacctcttcagccatctgcctcatcttccactggcttttggtgtccttgccattgaggagggtgggggcctagggtcaccttcaaggccaggccagctggccagtacctggccacctcctcacacttaccccggggcctgtctgcctcctccctggcagaagtctgcccttctttggccacctgggatcagaacagtctctgctgtactgttgatgtgcatcgtgctgtggaatttgggtttacgtcttgctgtcccatgcgcgaagctgcctggctgagcattcatcatgtacgcttgtgaactccagctggggagctgagactggttttcctgactttctagaagtcccgtctcccctttacacaggaagacatacccaagagtgctctgtgaggcccacttccggactggccccttagtggaaaagggaagctgggtctacctggcttgtatctttaatgcatttcttaggttcaagtggcatctttctcctgcttgctgctttggtgtgaggctagtgacatttaagataagcacctgaggaagaagagtctttttagtgtgactttgggcaaggctcttacccttggggtgtacctgtccacctttcatctctgaaatgaagagggtggacaggatcactgcttcccagtccacggaggagcttctggacggtacagatacaggggcacttgccccagaggtcttttccataggtctggggatgggactggaaatctgtgttcctaacgatttctagatcattctgaagtgtagttaggcttgggaagcagtagactgattcaactctaacattctgggaacc

SEQ ID NO: 451988 - DNA, 6007 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451989 - DNA, 5968 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcaggggtctctactaaaaaaaataaaaaataaaatagccgggtgtggtggtgggtgcctgtagtcccagctacttgggaggctgaggcagaagaatggcgtgaacccgggaggcggagcttgcagtgagccaaaaccgcgccactgcaccccagcctaggcgacagagcaagactccgtctca

SEQ ID NO: 451990 - DNA, 5033 bp, Homo sapiens
cagttttaggttcacagagatttcccatatcctccccactatcaacatcctcaccagagtggtacatttgttgaaactgatgaatctacattgacacatcatcacccaaagtccgtagtttacattagggttcattttaccactttttctttctctatctgttcatctggaaacatactttgttttctctctatttagacaggtatggataaggtatatgtagacatactttttccccaaatcctttgacggtaaattgcagatatcctgacaattcaccactaactactataactgcatctcctaaaaacggataccatccttcatgattacagtattgttaccatgtttagagaattaataatcatcctgtaatatcatctgatatccagctcatacgcaaattgcatggaaaaatttgtgtgtgtgtggttgactaatagccatcttttggcatgctctttgttttagaacttaaaaggaagtttcaattacaaaactaatacatgctcattgaaaaaggtctaaaagagaaagtaaaatcgcctgtcaccctcccccctacttgtgccctgtgcctgttcagtgggactcctctgtctgctctgggcctctccgagaggccctgccagtgctgcacagcctgtgacctcctctgtccaggaaagtggctgcatctaacgcacaccctcttccctccagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451991 - DNA, 3921 bp, Homo sapiens
  misc_feature (44)..(44): n is a, c, g, or t
tgctgccagaggttacgttcggcagtatgtgactctggtggtgnatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451992 - DNA, 4427 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggactttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451993 - DNA, 4644 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcaagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451994 - DNA, 2766 bp, Homo sapiens
agcatctggaaagctcgcctgtcttcgtctgcatcctgctgatcttcctgtgcccaggacgctccttggcttatgggtgaaacaggcatgcgttgctcaacctgaagtaacagcgagagctccttccagacatcactcagcttcctgttcacgtccttgaagagtattttgtcctggcttgctgttagaaacctgcagatattggatctattgctgaacttttctatctccccattagcctcctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451995 - DNA, 2703 bp, Homo sapiens
taaagatcacgtgggagactgttactgagcttttccttatggaaaagcaggtgggaggggagctctacctgaaaatgcttcatgggtgctttaaagcctcccccacctcctcttcaccgcactgtgctccaggtcggagcatcagagaggggcagaggagggcaattgttgccgagagaaccgagatggtgttgagcactggaaaatgaattcctgtcttttttctccctgcaccccacgccttcctgctgcttctcctcgtcttcctcctccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451996 - DNA, 4406 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcatttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451997 - DNA, 3519 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451998 - DNA, 2005 bp, Homo sapiens
tcctcctcctggcgcatgtctgcaactactctatagaatatctgatcatttatctggcatgcaacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 451999 - DNA, 1354 bp, Homo sapiens
tcagtcggtcccctctcaagacctgcgggggggcagaagcaggaagcagcattttgagggcagaagcaggaagcaggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 452000 - DNA, 2884 bp, Homo sapiens
  misc_feature (2754)..(2754): n is a, c, g, or t
  misc_feature (2757)..(2757): n is a, c, g, or t
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctctttggagctgttggttttgaccctcaccccccgatgcgggccacaggcctcccctcaagcctggcctccattcctggaggaaaaccaacagaaatccaatctagagctgctccgcatctccctgntgntcatcgagtcgtggctggatgccttcctctaggtcctttaggaggtgatagtcatcgctgtccgaggtgtcatacaccaggttgttggcgaacatactcctgaggaaccgcacgggctccagccacg

SEQ ID NO: 452001 - DNA, 2497 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagtataatgggtaggcaccatgggctgggttaatctgattggggggagggggtctgctcttggccaggg

SEQ ID NO: 452002 - DNA, 2193 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcggggtacgtggactccccaatctgcctcttacccagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggggaagggaagggaagaaagaagagaaggaagggaaggaagagaaaaagagaaagagaag

SEQ ID NO: 452003 - DNA, 2811 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcggggtacgtggactccccaatctgcctcttaccgtgtgtatagcccttttattcctctcatttatcataaccagagattgaccctgaccttagctggcctcaaagaatggcggccccagggctccggcttctacaagcaccccaagggcttggacccatgtagggctgtttcccccttggctcccagttgcctcctagtcctcaaactaaaggggagccagacacgcctcaaatccacctcttcagccatctgcctcatcttccactggcttttggtgtccttgccattgaggagggtgggggcctagggtcaccttcaaggccaggccagctggccagtacctggccacctcctcacacttaccccggggcctgtctgcctcctccctggcagaagtctgcccttctttggccacctgggatcagaacagtctctgctgtactgttgatgtgcatcgtgctgtggaatttgggtttacgtcttgctgtcccatgcgcgaagctgcctggctgagcattcatcatgtacgcttgtgaactccagctggggagctgagactggttttcctgactttctagaagtcccgtctcccctttacacaggaagacatacccaagagtgctctgtgaggcccacttccggactggccccttagtggaaaagggaagctgggtctacctggcttgtatctttaatgcatttcttaggttcaagtggcatctttctcctgcttgctgctttggtgtgaggctagtgacatttaagataagcacctgaggaagaagagtctttttagtgtgactttgggcaaggctcttacccttggggtgtacctgtccacctttcatctctgaaatgaagagggtggacaggatcactgcttcccagtccacggaggagcttctggacggtacagatacaggggcacttgccccagaggtcttttccataggtctggggatgggactggaaatctgtgttcctaacgatttctagatcattctgaagtgtagttaggcttgggaagcagtagactgattcaactctaacattctgggaacc

SEQ ID NO: 452004 - DNA, 5980 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 452005 - DNA, 4805 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtg

SEQ ID NO: 452006 - DNA, 4498 bp, Homo sapiens
aggaagacgggatcagcgcttatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcggggtacgtggactccccaatctgcctcttacccagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 452007 - DNA, 4138 bp, Homo sapiens
atgatacaatcgagctcggtacctgaacattcgtgtccacggggagaccgtgttgagctggagtggagcctgttgaagggcagggctggagtagaaagcatggactttggggtttggcctggcttcaggtcctggccagtagaaggacagggtggtttgggctcagtcaggggtggggaaagtgtggcctcttactgaccagttggcttctctcttggttgcaggacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 452008 - DNA, 3328 bp, Homo sapiens
gcagtgacggtttctcaccttttcagagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 452009 - DNA, 5365 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatgttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgcttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgt

SEQ ID NO: 452010 - DNA, 3244 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatgtgagcttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggtgagccggcaggagggagcattagtgcctcgtcctgggga

SEQ ID NO: 452011 - DNA, 2491 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcgctctcacacgcccatctccagttccagctccgttctaaagatcctgctagagtcac

SEQ ID NO: 452012 - DNA, 2163 bp, Homo sapiens
actataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggggaagggaagggaagaaagaagagaaggaagggaaggaagagaaaaagagaaagagaag

SEQ ID NO: 452013 - DNA, 9082 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaa

SEQ ID NO: 452014 - DNA, 4911 bp, Homo sapiens
ctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgagcgggcccaaccaataggcccatgctcatctccctggacaagcagacatgcactctcttcttctcctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaa

SEQ ID NO: 452015 - DNA, 9426 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaaaaaaaacaatgccaacggactgagggtctctgaaaggaaccccccacaaaatttaacagccaaaattttcggttaaaaaaaaaacttttgggccccttgggcccattgaattttgacacttgcaaacttttttcttggcgccccaaatttgggcctcaattgggccaattccgccttatgggggggccgttttcacatttcaatgggcccgagttttaaccacctttgtgaactgtgggcccttgggggttacccaaacttaaactggccttgggaaacaaattccctcttttcccaaggtggcgctaattacccggagggccctccaccgtgcggccttttcc

SEQ ID NO: 452016 - DNA, 7701 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtcctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaa

SEQ ID NO: 452017 - DNA, 7448 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaaggtaatccgtggcttcccacaaagttccacatttaacttcctccaaggaaggggattaaaattttcaactaactcccttcagttgaaatctcggaccacttttaaaacaaaaaccttggtctaattctttactttgttatgaatttcttgacagtggattgagcgatacgtgtcagaactaagcatttcactgtaggcaaattgtgtcttagttatcaagtaaatgtacaaaaaaactaaaacctggtctgatccagtggttctgaggttgggtggaggctgagctgtgcacagtcagaattgcctttgatttggttttaaccatgacacttccttattttggaatgccaaataatattagagaagggtaagagattttatatttgtaagaaggatgaaaggaaactggcctaaatgttaggatgtaggttaaaatcaaccaggacgcacatagggcagagtccagggtgtgaaggaaggttttaaactggcactaataagggtgttgccctttgttccctcacataatcgtgaaaggctgcttttgttttgaacagctagtcttaactatatacctttcataatttgatttttgaaccgtgtgtggatgtaataactctttaaaaaaaaatgaagtgtgtttaaaga

SEQ ID NO: 452018 - DNA, 6406 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtgagtgccttcccagtccacccgcggcgccacaccctcagcatgtgaacttcagactgcttgacgatggttggctcttttgggttctcaagatgggaatactatgcccatgtgaggctgatggtggttgagttgtgactgttcctggaagcagcccgcagtgtcaatcctggcacagagggtggttctgag

SEQ ID NO: 452019 - DNA, 5408 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagtaagtatgacaaatccaagggtggagataatttttgcaagacttttagtgataacctttgcgttgtttcttgccttcagtggggagttgctcaag

SEQ ID NO: 452020 - DNA, 2664 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctcccagccctactcgggatgagtgctttgcccgtcggggcttcattaccccaaatatgaccgggacatcttgaccattgacatcggtcgatgtcacccccaacctcatgggccacttctgtggacccaaagagtctcaccaggcataacatattccggggctgatccaaacatgactgcccgtgctgtacctgcatttcaga

SEQ ID NO: 452021 - DNA, 420 bp, Homo sapiens
gactattacatttgtttgcccgtcggagcggagagaggtaagtgactcgtctcctgatcactaatgtggcgcacagtagcctgggttgcccatgcgaacgcgtttctgggcttggggcagggtgggcctggatgcaggaagctgggagccatgacagaggcactggtgggttctcaggagaagacaagcttcctgggatagcttctgtcacatgcagctcactcagggagagctgtttgcattttgccttttgcttttttacagcaatccggaggggcctccacatataatgggatggtgttttgttctagtctctgtgagattattttaagtagttcacggacagatttttttttggtagttgggttgttttagtgaatagtggaaaaacgaagtagaatttcaagcctgtgatttctt

SEQ ID NO: 452022 - DNA, 411 bp, Homo sapiens
ggcagagtggctggggcaaagctacaaattaacaacatctcagcaaagcaattgtttaaagtacagggctttttcaaaatggagtctcttatgtcttccctttctgcatagacacagtgacagtctgatctctctctcttttccctacactccccagcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtgagtgccttcccagtcc

SEQ ID NO: 452023 - DNA, 383 bp, Homo sapiens
cttaagagaacatttggagtttgagaggagaatgactgaggatttcttcccatgaactcactcaatgtacttgcacagctggggcggtagaattcctttggattagttacacaaaatcccaacatgattttatgaagctttggtctcagaatttgcagatttgggaacctcttgatgaccccgtttaactaaagcggttgcatcccctgcccttcttgctgctgctttctttattttagtagcctttactgcattctcattttaaagaagaatctttacaatgtgtggtatggtaacattataattactatttttttttaatagggaactcctgaatttgtaactgcaacagaatgtgtgcactactttgagtggaggaccac

SEQ ID NO: 452024 - DNA, 330 bp, Homo sapiens
gatgtaaagtgagaggagatgattgcacaacagtcctcatgtaagagagaagagataccgaaaagaacgcagaggagccaagacgtttattgacctttgcctgagttcgttattaggggacaccatagcatgatagtccctaaggaatggagagcagtgttgtgtgacattggtcataagcttttctgattgaccaagatgtatactgaagactcacttttttcttcctcccttccaggtgccatgctatgtgtttgatgaagagttgaggaagcatgatctcaatcctctgatcaagcttagtggtgcctacttggtggatgactccga

SEQ ID NO: 452025 - DNA, 979 bp, Homo sapiens
ctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgagcgggcccaaccaataggcccatgctcatctccctggacaagcagacatgcactctcttcttctcctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaa

SEQ ID NO: 452026 - DNA, 9234 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaaatttgaaatctggttaggctggtgttagggttctttgtttttggggtttggcagagatgtgtttaagtgctgtgaccagaagcggggggagggggggtttggtggaaattttttgttatgatgtctgtgtggaaagcggctgtgcaaacatg

SEQ ID NO: 452027 - DNA, 8910 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagatccagctgcctcctccacggcagggaaaggaagggcaggagaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggagcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgggacagccaagcacctccaaccaaataagacttccactcgatgatgcttctataattttgcctttaacagaaactttcaaaagggaagagtttttgtgatgggggagagggtgaaggaggtcaggccccactccttcctgattgtttacagtcattggaataaggcatggctcagatcggccacagggcggtaccttgtgcccagggttttgccccaagtcctcatttaaaagcataaggccggacgcatctcaaaacagagggctgcattcgaagaaacccttgctgctttagtcccgatagggtatttgaccccgatatattttagcattttaattctctccccctatttattgactttgacaattactcaggtttgagaaaaaggaaaaaaaaacagccaccgtttcttcctgccagcaggggtgtgatgtaccagtttgtccatcttgagatggtgaggctgtcagtgtatggggcagcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggatggggggacaaggaggatcttacaccccaaaagtgttctgaaccccaatcctcaaaatgaagatactgtcaccacctttgcccttcacataaccactcactctctctaacccattccttatgatttcctgtgtttcgacctgtcctcacattaatgtcccctttggtggtg

SEQ ID NO: 452028 - DNA, 7571 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagacatgcactctcttcttctcctggcacacgccgctggcctgcgagcaagcgaccgaatgttccgtgaggaatggaagctctattgttgacttgtctccccttattcatcgcactggtggttatgaggcttatgatgagagtgaggatgatgcctccgataccaaccctgatttctacatcaatatttgtcagccactaaatcccatgcacggagtgccctgtcctgccggagccgctgtgtgcaaagttcctattgatggtccccccatagatatcggccgggtagcaggaccaccaatactcaatccaatagcaaatgagatttacttgaattttgaaagcagtactccttgcttagcggacaagcatttcaactacacctcgctcatcgcgtttcactgtaagagaggtgtgagcatgggaacgcctaagctgttaaggaccagcgagtgcgactttgtgttcgaatgggagactcctgtcgtctgtcctgatgaagtgaggatggatggctgtaccctgacagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatcctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggcgaagctgtggtgtagcacaactgcggactacgacagagaccacgagtggggcttctgcagacactcaaacagctaccggacatccagcatcatatttaagtgtgatgaagatgaggacattgggaggccacaagtcttcagtgaagtgcgtgggtgtgatgtgacatttgagtggaaaacaaaagttgtctgccctccaaagaagttggagtgcaaattcgtccagaaacacaaaacctacgacctgcggctgctctcctctctcaccgggtcctggtccctggtccacaacggagtctcgtactatataaatctgtgccagaaaatatataaagggcccctgggctgctctgaaagggccagcatttgcagaaggaccacaactggtgacgtccaggtcctgggactcgttcacacgcagaagctgggtgtcataggtgacaaagttgttgtcacgtactccaaaggttatccgtgtggtggaaataagaccgcatcctccgtgatagaattgacctgtacaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaaggagaggagggaaacagtgataagtaagctgaccacttgctgtaggagaagttccaacgtgtcctacaaatactcaaaggtgaataaggaagaagagacagatgagaatgaaacagagtggctgatggaagagagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaa

SEQ ID NO: 452029 - DNA, 5150 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgtgaggtgaaagacccaaggcatggcaacttgtatgacctgaagcccctgggcctcaacgacaccatcgtgagcgctggcgaatacacttattacttccgggtctgtgggaagctttcctcagacgtctgccccacaagtgacaagtccaaggtggtctcctcatgtcaggaaaagcgggaaccgcagggatttcacaaagtggcaggtctcctgactcagaagctaacttatgaaaatggcttgttaaaaatgaacttcacggggggggacacttgccataaggtttatcagcgctccacagccatcttcttctactgtgaccgcggcacccagcggccagtatttctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggagcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccaggtcaccaacccaagcacaggacacctgtttgatctgagctccttaagtggcagggcgggattcacagctgcttacagcgagaaggggttggtttacatgagcatctgtggggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaa

SEQ ID NO: 452030 - DNA, 3845 bp, Homo sapiens
  misc_feature (1674)..(1674): n is a, c, g, or t
gagcccagtcgagccgcgctcacctcgggctcccgctccgtctccacctccgcctttgccctggcggcgcgaccccgtcccgggcgcggccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtgactctgttttgagaagtgcaaccagatctctcctggaattcaacacaacagtgagctgtgaccagcaaggcacaaatcacagagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaagcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccaggcgtttgatgttggccagccccgggacggactgaagctggtgcgcaaggacaggcttgtcctgagttacgtgagggaagaggcaggaaagctagacttttgtgatggtcacagccctgcggtgactattacatttgtttgcccgtcggagcggagagagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccgatattcggatggagacctcaccttgatatattttggaggtgatgaatgcagctcagggtttcagcggatgagcgtcataaactttgagtgcaataaaaccgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcagaaccagagcagaattgggaagctgtggatggcagtcagacggaaacanagaagaagcattttttcattaatatttgtcacagagtgctgcaggaaggcaaggcacgagggtgtcccgaggacgcggcagtgtgtgcagtggataaaaatggaagtaaaaatctgggaaaatttatttcctctcccatgaaagagaaaggaaacattcaactctcttattcagatggtgatgattgtggtcatggcaagaaaattaaaactaatatcacacttgtatgcaagccaggtgatctggaaagtgcaccagtgttgagaacttctggggaaggcggttgcttttatgagtttgagtggcacacagctgcggcctgtgtgctgtctaagacagaaggggagaactgcacggtctttgactcccaggcagggttttcttttgacttatcacctctcacaaagaaaaatggtgcctataaagttgagacaaagaagtatgacttttatataaatgtgtgtggcccggtgtctgtgagcccctgtcagccagactcaggagcctgccaggtggcaaaaagtgatgagaagacttggaacttgggtctgagtaatgcgaagctttcatattatgatgggatgatccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggagcccctggaatgcgtagtgaccgacccctccacgctggagcagtacgacctctccagtctggcaaaatctgaaggtggccttggaggaaactggtatgccatggacaactcaggggaacatgtcacgtggaggaaatactacattaacgtgtgtcggcctctgaatccagtgccgggctgcaaccgatatgcatcggcttgccagatgaagtatgaaaaagatcagggctccttcactgaagtggtttccatcagtaacttgggaatggcaaagaccggcccggtggttgaggacagcggcagcctccttctggaatacgtgaatgggtcggcctgcaccaccagcgatggcagacagaccacatataccacgaggatccatctcgtctgctccaggggcaggctgaacagccaccccatcttttctctcaactgggagtgtgtggtcagtttcctgtggaacacagaggctgcctgtcccattcagacaacgacggatacagaccaggcttgctctataagggatcccaacagtggatttgtgtttaatcttaatccgctaaacagttcgcaaggatataacgtctctggcattgggaagatttttatgtttaatgtctgcggcacaatgcctgtctgtgggaccatcctgggaaaacctgcttctggctgtgaggcagaaacccaaactgaagagctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacacctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggtaggactgggcctgtccctacaagtcat

SEQ ID NO: 452031 - DNA, 286 bp, Homo sapiens
aggacacattctgaccctttgcttttcctaatctgcgcctcatcccacaggcacatggagacagaaatgtcacatgctgtggagtttttcagagaagcttccacttgtaagttgaaatcatgatagacatggagtttttgcgtgatcccttcaggacctgtctgtgctttgttgtagaactccaggcccatgttcatcagcgccgtggaggactgtgagtacacctttgcctggcccacagccacagcctgtcccatgaagagcaacgagcatgatgactgccagg

SEQ ID NO: 452032 - DNA, 778 bp, Homo sapiens
gttgcttggtttatatcattgttgaaattaaataatattgtgctatatttgtgtttaattattcaggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcaggtaaaatattttacaccattattttatttttcttgaatgctgataacctttggtaatgttggaaaagataactaaagtcactttcaagggaattaatggatacatattttaagtgggacttctactattgatgcagtcctagaaaaagcctcctatgtgaaaaaagagtttactagaaatccctgttgttaactgagtaatagacagtcagttctgaactttttttcatgtaggatcacatttttctgttcacttagttcaatagtagtacaagtacataaacatagcagtagacaagatagaaatgagagaatttagtcttttgtatttcctttggaataatttgtgcttagtcaactgtgattttccagtttgcggaaattaaacattttcattgatgtttgtttgacctgactctctcacctccttttgacttgaaccttgcagcactctggagtctccttgaaccagaaccacagtct

SEQ ID NO: 452033 - DNA, 581 bp, Homo sapiens
cttcactaaatatgccgtagtaatcttcttgtggcattctaaattcattccctcagaaagattgtgatttagaaacttttcttttgatcatgatcacataactcaattccagaaaaattaatgagagagactctaagcaaatttcaatttatattgagattttaataaagaatgttttcttcatgttattttacttactgttatagtgtgactgttgcttttttgtctccttttcttttaaacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagagtaagtatttaaattggttacataagcaaaaaaaaaaaaaaacccttctggagctagaaagtaggaagaagtataagtggaaaatattaaatttcttctttcctagccattttttaaagtaaaaaaaaaaaaagcgaagttacctttcttt

SEQ ID NO: 452034 - DNA, 216 bp, Homo sapiens
aggtatataagcaatttctaattttataattttgggcaatttgaatttcctttattactataatccatgtctctgatgccagttagtattactatactgtacttaggaatgcagaatcacatttggaacttgaaaatttgcacttttgcatagttgggattctagagagttagtcaagtcagttgtcatactataaattcaccatagaacaaccaa

SEQ ID NO: 452035 - DNA, 3227 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452036 - DNA, 3523 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggtattatttattcaggtcgttttattttcttaaacactttaaaataaaatgtctatacttgcattaattacttataaggaatttaaaataatgtctattagctttttaatagcatttttcagatcctatgggagtttcagcttgagataaaagactatatattatctctgttctttattatatatcagaattcaaaaattccagaaagttggcttctgaagtagaataatgctattatatttaaactttatatatatgtagtataaaaacttccattcgcttgtattttgaattaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452037 - DNA, 3163 bp, Homo sapiens
  misc_feature (3127)..(3127): n is a, c, g, or t
  misc_feature (3129)..(3129): n is a, c, g, or t
  misc_feature (3132)..(3132): n is a, c, g, or t
  misc_feature (3134)..(3134): n is a, c, g, or t
  misc_feature (3136)..(3136): n is a, c, g, or t
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggtattatttattcaggtcgttttattttcttaaacactttaaaataaaatgtctatacttgcattaattacttataaggaatttaaaataatgtctattagctttttaatagcatttttcagatcctatgggagtttcagcttgagataaaagactatatattatctctgttctttattatatatcagaattcaaaaattccagaaagttggcttctgaagtagaataatgctattatatttaaactttatatatatgtagtataaaaacttccattcgcttgtattttgaattaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaatttgaactngncanantngctcagatcttgggaagtaacatcttc

SEQ ID NO: 452038 - DNA, 3153 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452039 - DNA, 2353 bp, Homo sapiens
  misc_feature (2317)..(2317): n is a, c, g, or t
  misc_feature (2319)..(2319): n is a, c, g, or t
  misc_feature (2322)..(2322): n is a, c, g, or t
  misc_feature (2324)..(2324): n is a, c, g, or t
  misc_feature (2326)..(2326): n is a, c, g, or t
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaatttgaactngncanantngctcagatcttgggaagtaacatcttc

SEQ ID NO: 452040 - DNA, 3171 bp, Homo sapiens
  misc_feature (8)..(8): n is a, c, g, or t
  misc_feature (47)..(47): n is a, c, g, or t
ggccaagnccgtagtgacgtccctctctagaccggatgctctctacngtagcgagttcaggtataaatcctggtttattttgaaacttcctattacttaagtttactgacatttccaaggctttattatattaatatctggtcacactcaacacatgcatatatttttgaacactgaaatgcatacttcagttccatttgaggtccatatagattctgtgtgttttagtcttgcttaaattatttctactacttctttgcacccctttgctagttttctcagtgccgtagggtttattaaataataattggactctagtaattttttttaatgagagagagggaaactatatttgaaattggattgggacatttattttacttaaacagaagtttgcttatgacacataatctagatgggatatatcttatctatagtgtatccacctgctgtaagtagatactgtatttgtatagccattattttgctgtaagtactttatcattttaattaaattgattaagaggaaaaaaaaagaatggaattctctttgatgcaactttttccccccagaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452041 - DNA, 2524 bp, Homo sapiens
taccgtggctccaactttctacagttcatgttgtcctagcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452042 - DNA, 1283 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaagtataaagcgttgagctcacgctttatactttctcagcgctttatacttcctcacgctttatacttccgtattgattcagtataatattaagtatgcatggagaagtataagcgtga

SEQ ID NO: 452043 - DNA, 2147 bp, Homo sapiens
  misc_feature (17)..(17): n is a, c, g, or t
gacattctcatgcacancgagtgttcaacacaagaagcaagtccatttataggtagtccaagcaatatttgtgtgtgtgtgtgtgtgtgtgtgtaagtccgtaagtccagatactaaagctcagtttatgattttagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagaggtaaatacatcatttgtccaaaaattgtaaagcagttttatattgtgaatttttagttaaactgaaaacaagcaagtttatttaatctcaacatttactctgattttagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452044 - DNA, 1241 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggtaagttgcacatatctgataacattgccagtaattttactgaggtaatactagttaacagaaattcctttatgaattcgagttaaaaaattaatgaatcacagccgggcatggtggctcatgcctgtagtgccaactacttgggaggctgaggcaggaagattgcttgagcacaggagtttgaggctgcagtgagctttgattgtgccactgcactccagcctgggtgacagagcaaaacccagtctctttttttttta

SEQ ID NO: 452045 - DNA, 1791 bp, Homo sapiens
ttctacacctgacctcatatgataggtcacagtcaaagtgcagtcagaactttgtttcaggcacagaattagtaaatatattatataaaattacttttagcctatatgaaacatgagtgaattttgtgtttagacctgaatcccattccccaagatatctcattatatatatgcaaacattccaaaatccacaacccttctggtcctaagcatttcaggtaaggcatgcttaacctgtaccagttatacttatgattgaaggcctaatatctggtcagaaatcaacatctaattattatattattttaatgaaaaaaattttttgtggtagttaactaggaatgtaaattactaaaaaggattgcttataattaatagtaattgcatacaattttgtggagttgcagcttaaaatggattagaaaatttccagttttgttttatattttgaaataaatatttaactggttatctttccagtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452046 - DNA, 423 bp, Homo sapiens
gaggctgaagtggagggatcacacctgagcccagggggcggaggcttcagtaagccgagactgcaccactgcactccagcctgatgacagagatatcttgtctcaaaaaaaaaagtaatacaaatttcatgtaatataaatatttaaaaagcaaccatatgttttgttctacaaaataattgggtaaaaagtttcagaataacagtagataactaagaaatgtaaaaggacatactgatattttgatcacatatgaatgatttaaattacccaatttatcattttagataatacaccaatttcaaatctggtattagaatattcaagggagaatttggaattacatatataatgatccaatttttttcttttctctagcacttggttaatgaatggttaagtgagaagaatgagaagacagga

SEQ ID NO: 452047 - DNA, 238 bp, Homo sapiens
ggggtaaaagtcataactgccattgtttatattttatctttcccagaatgtgacacaaacagattttaacaaatagcaacagtgtaatttcttacagattattatttcaccaacagatttaactacaccactaaaaaaacgaagattttatcagttgctagattcggtttactcagaaacctccacacctactccttccccgtatgctacaccaactcacaccgatattactcctatg

SEQ ID NO: 452048 - DNA, 524 bp, Homo sapiens
tatgtccagttttttaggaaactaactagaattccatgtttattttaggcatttcgtgaaggatctaggaagtcatcaagagttaaggtaaatacattaattttaaggtgttgttatcaactgtcatttattcaggagctacatgcttgcttgaccatatctttacttaatgctctgtttattgtgtgtcatgtctttgcctattatctttaccaggagtgggaccttagttctaattggagtaatatactactcttgtagttaacactgttaaaatattaatcaaaagggggaggtatataagcaatttctaattttataattttgggcaatttgaatttcctttattactataatccatgtctctgatgccagttagtattactatactgtacttaggaatgcagaatcacatttggaacttgaaaatttgcacttttgcatagttgggattctagagagttagtcaagtcagttgtcatactataaattcaccatagaacaaccaaatcaatacaaaccag

SEQ ID NO: 452049 - DNA, 706 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagagtaagtatttaaattggttacataagcaaaaaaaaaaaaaaacccttctggagctagaaagtaggaagaagtataagtggaaaatattaaatttcttctttcctagccattttttaaagtaaaaaaaaaaaaagcgaagttacctttcttt

SEQ ID NO: 452050 - DNA, 2682 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatggtaagttgggaagccagtagtttgggcttagtgacagctgctctgcatatggtaattgttgctgcctttacatgggcttttacattattctttgaagttagcgaatgatgtgccattgagcatttttatttggtttggtcattgccatttaaataaattccattaatcttgtatttttattggttgttcattagagatttaagaatgtatgacatttaagaaatatgaacattttggaagtaataatattttaataatgccacactgaactattaataaattttaatgccacaattactgttcagaatgtcttttattagctaaatgtatcctctcatgatttgaaatataataaaagtacaaatttaaaccttactatagcaccaaataaattgcttatgc

SEQ ID NO: 452051 - DNA, 2370 bp, Homo sapiens
  misc_feature (2354)..(2354): n is a, c, g, or t
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagaaatttagagaaggnactggggatcctctag

SEQ ID NO: 452052 - DNA, 3078 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgacactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452053 - DNA, 4128 bp, Homo sapiens
ctatcttacccaagctactcctgaactccaggcttcaagtgaccctcctgtctcagactcccaaagtgttgagatcataggcatgagccaccacacccagcccttattttctatgtttagatgtgtttagatacagaatacttagcattgtgttacctacaatattcagtgcattgtgttacctacgatattcagcgcataacatgctgtatagatttgtagcctaggagcaatagttatgccatttagcctaggtgtatagtaggctataccatctaggtttgtgtaaagtacactctatcatgttcacacaacggtgaaatcacctaatgatgtatttctcagaatgtatctccaatgttaagcaaagcatgactatattcagaacataatggagactcttcacaatctcctttagaaccattagataacctcagtttgtatctcctctttttgctgattctggcacacagcgcttacaacagcagccactgagagctaaattgagacttcgtgaagggatgacagtatattaagaagcagttgactgtaaaaaatgttttttatgctgctagtctcatgactaatcagaatataaccactaaatatccttaaactaaataatagtgcaaatagtactaagttctaatgtaaagttttaataggaggtaggataaagattgtcatgaaaaatttttcaagtgatgttatagttttgtaaaataaaggcacagaaacaaatcatgttattgagtatttgcaagggagagattaattttagtgtgaactgacctcagatgtaggttcacaaccttgttgatcaataggaattaaccaagtagagctcaggaggattggtaagagtaaagaagttgggaaagtgatgtatgtaaaatgctaggccagggagcttgtaagtcaacaacagtgggcaaattgtatcagtagttgatcagtctccatcatctaagaccagaattgctcatcttacagatagctgtttatgttttttttcaggtataaatcctggtttattttgaaacttcctattacttaagtttactgacatttccaaggctttattatattaatatctggtcacactcaacacatgcatatatttttgaacactgaaatgcatacttcagttccatttgaggtccatatagattctgtgtgttttagtcttgcttaaattatttctactacttctttgcacccctttgctagttttctcagtgccgtagggtttattaaataataattggactctagtaattttttttaatgagagagagggaaactatatttgaaattggattgggacatttattttacttaaacagaagtttgcttatgacacataatctagatgggatatatcttatctatagtgtatccacctgctgtaagtagatactgtatttgtatagccattattttgctgtaagtactttatcattttaattaaattgattaagaggaaaaaaaaagaatggaattctctttgatgcaactttttccccccagaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452054 - DNA, 2995 bp, Homo sapiens
cttcagattgggtaccaccgtatccctcacaagctacacatcataccactttgggaccgggaccccagcaccagccttctggaacagggccacattgtccattacctgtcacaggtcctcatctccagccccaaggaccaaacagtattccaacacctactgcctcagcgtcctgagtagctgggattacaggcacatgccaccaagcccagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452055 - DNA, 3045 bp, Homo sapiens
gtctctactataaatacaaaattagccaggtgtggtagcacatgcccggaaccccagctacttgggaggctgaggcagggaatcgcttgaaccaggaggcagaggttgcagtgagccaagattgcgccattgcactccagcctgggcaataagagcgaaactccatctcaaaaaaaaagcagtatttatttcaaaagtgaaaataattaaaggcaatggtaataatggaatagattcaattcagtgtcatacatttgctttaagaaatttaatttatgattttaattacattgttaacattatgggtttttttttttcagactttttgctttaaatattctgtttgaaaaaaatactggtttcctaagtaaattattttcttggccattcactgtggctcacatctgtgatcccagctctttgggaggcaggggtgggaggatcacttgatccaggagttcaagaccagcctgggtaacccatctctacaaaaaattaaaaaattagcccggcatgatggtgcaggcctgtagtctcagctactcaggaggctgaggcaggaggatcccttgaacctggaaggttgaggctgcagcaaactgtgattgcatcactgcactccagcctgggtgatagggtgagaccctgtctggggaaaaaaaaaaaaaaaaaaatcagagtgaaatggagtcatctatctggcatctactgctactattagactgtatgtaaactgtattgcaagggattttgtatatattttatactgttggtttttcactgagaacattaaataaattaaaaagtttatcacatttaagacagatctgcttcatgtatttgataaataattatgctaattttttaatgtaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtacagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452056 - DNA, 1382 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagacgtcatacttggaaatggctgcaggttcagaaccagaatccgtagaagctagccctgtggtagttgagaaatccaacagttatccccaccagttatataccagcagctcacatcattcacacagttacattggtttgccctatgcggaccataattatggtgctcgtcctcctccgacacctccggcttcccctcctccatcagtccttattagcaaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcaggtaaaatattttacaccattattttatttttcttgaatgctgataacctttggtaatgttggaaaagataactaaagtcactttcaagggaattaatggatacatattttaagtgggacttctactattgatgcagtcctagaaaaagcctcctatgtgaaaaaagagtttactagaaatccctgttgttaactgagtaatagacagtcagttctgaactttttttcatgtaggatcacatttttctgttcacttagttcaatagtagtacaagtacataaacatagcagtagacaagatagaaatgagagaatttagtcttttgtatttcctttggaataatttgtgcttagtcaactgtgattttccagtttgcggaaattaaacattttcattgatgtttgtttgacctgactctctcacctccttttgacttgaaccttgcagcactctggagtctccttgaaccagaaccacagtct

SEQ ID NO: 452057 - DNA, 1734 bp, Homo sapiens
agcgggcgcgcggcgccgcgccgccgccgccattttcccagagcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacagggtttgtggatgcacttagatgtttgcaatgagcactgtggctggcatgccccagtgttttggataccaatgcataggactccatagtaatcgaatttaccagaggcgaacgtcatgagcatagtgatcccattgggggttgatacagcagagaccagacggaaaaaaggaaaaaaagacaaagatatttcaaaagaaaaagatacacaaaatcagaatattactttggattgtgaaggaacgaccaacaaaatgaagagcccagaaactaaacaaagaaagctttctccactgagactatcagtatcaaataatcaggaaccagattttattgatgatatagaagaaaaaactcctattagtaatgaagtagaaatggaatcagaggagcagattgcagaaaggaaaaggaagatgacaagagaagaaagaaaaatggaagcaattttgcaagcttttgccagacttgaaaagagagagaaaagaagagaacaagctttggaaaggatcagcacagccaaaactgaagttaaaactgaatgtaaagatacacagattgtcagtgatgctgaagttattcaggaacaagcaaaagaagaaaatgctagcaagccaacccctgccaaagtaaatagaactaaacagagaaaaagtttttctcggagtaggactcacattggacagcagcgtcggagacacagaactgtcagcatgtgttcagatatccagccatcttctcctgatatagaagttacttcacaacaaaatgatattgaaaatactgtacttacaatagaaccagaaactgaaactgcactagcagaaataattactgaaactgaagttccagcacttaataaatgtcctaccaagtaccccaaaacaaagaagcacttggttaatgaatggttaagtgagaagaatgagaagacaggaaaaccttcagatggcctttcagaaaggcctctacgcataactacagatcctgaagtgttagctacacaactcaattctttaccaggtctcacttacagcccccatgtatactccactcctaagcattatattagatttacttcaccattcctttcagaaaaaaggagaagaaaagaacctactgaaaacatttctggttcatgcaagaagcgatggttgaaacaagctctggaagaagaaaattcagcaattttacatagatttaattcaccctgtcaagaaagatccagaagtcctgcagtcaatggtgaaaataaaagtccactactattaaatgacagctgttcccttccagatttaactacaccactaaaaaaacgaagattttatcagttgctagattcggtttactcagaaacctccacacc

SEQ ID NO: 452058 - DNA, 1749 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaa

SEQ ID NO: 452059 - DNA, 135 bp, Homo sapiens
gcacgagctctctctctctctctctctctctctctctctctctctctcctataatatatttagtaatatatattattaccttaaaagtctatttttgtgttttgggcatttttaaataaacaatctgagtgtaaa

SEQ ID NO: 452060 - DNA, 2741 bp, Homo sapiens
  misc_feature (22)..(22): n is a, c, g, or t
ctacactgtcacacaaggcatngctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccattcgtggattgccagctggcaatccacgcatcactctcggccgacacccctcatggccaaccgttacaccatggatctgactgccatctacgaggtgagtccccgccgcacggcatccccggtacctgcatgcctgagtccgagtccccacctctctagcgccgcaaactccagcccgggacgcttgcctcccttctccaactggggctccctagcgccgcgccctccagcctggggcccctgcctcccgctcagaccagcttggtgatttggaggtgaaaatggaacccgcgacacccggctcttcgctcaaacatgggtggggcggcccatgcaagtggaaagtcggagaacttttctcagaccgaggctgcctggaggcggaagtggcccccatacctggctcacccctagtcgttgctgagggcgtggttttgcgcggaggcgtctctggggctgaagtctcagggtggggggatccgacttctgtctctccagtccctgaccgtagagacagagaaccctaaaaccgaagcaatccggacttccaggtcaactttgcccggtttctccagttgtgaaactggagatcccgacgcgtgggtcatatccggggaggacaagagacccaaaattgggaaacagtggtgcgccctgacttcggggtccccctcttggtccagccggggaagccgggattcctgggtccctcgggataaggcctcggtggtgggtaaactcagaacctccaactctgggttcctggcatccggaacccaggggtttctgcgggcgggtggggctcaggcggggagccacaaaccggcctggcaagctctagttccctgcagctggggtggggcgtcgccctgcattttcaggtgccttaaccgacccatttccgcagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaa

SEQ ID NO: 452061 - DNA, 1515 bp, Homo sapiens
cacaccgagctactccagccctgggcaataagagctactccagcctgggcgaataagagctactccagcctgggcaataagagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaa

SEQ ID NO: 452062 - DNA, 1718 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaa

SEQ ID NO: 452063 - DNA, 1750 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcactcattatggaggggtccgagctctgat

SEQ ID NO: 452064 - DNA, 1685 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaa

SEQ ID NO: 452065 - DNA, 1715 bp, Homo sapiens
  misc_feature (1617)..(1617): n is a, c, g, or t
  misc_feature (1634)..(1634): n is a, c, g, or t
  misc_feature (1713)..(1713): n is a, c, g, or t
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatcacgccacccccccccccccccccccccgccccccttctatttttcnccccccctccccaacancgaaaacgacgactcactcacactctcactctcactcacacgctcacgcacactcactcacactcactcactctatcangt

SEQ ID NO: 452066 - DNA, 1521 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaacttggactagtggtaccgagctcgatg

SEQ ID NO: 452067 - DNA, 1658 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggca

SEQ ID NO: 452068 - DNA, 1782 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaaaaaaaatagaagaaacaggaatgaaacacatttgggcggcctggccttggaaaaaggtttaagg

SEQ ID NO: 452069 - DNA, 746 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccccaatgaaataaagttattttctcattccca

SEQ ID NO: 452070 - DNA, 422 bp, Homo sapiens
  misc_feature (22)..(22): n is a, c, g, or t
ctacactgtcacacaaggcatngctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccattcgtggattgccagctggcaatccacgcatcactctcggccgacacccctcatggccaaccgttacaccatggatctgactgccatctacgaggtgagtccccgccgcacggcatccccggtacctgcatgcctgagtccgagtccccacctctctagcgccgcaaactccagcccgggacgcttgcctcccttctccaactgcatcgctcctcctctgttccatagatcccccgccatgcgtggattgccag

SEQ ID NO: 452071 - DNA, 1722 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggca

SEQ ID NO: 452072 - DNA, 1276 bp, Homo sapiens
  misc_feature (22)..(22): n is a, c, g, or t
ctacactgtcacacaaggcatngctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccattcgtggattgccagctggcaatccacgcatcactctcggccgacacccctcatggccaaccgttacaccatggatctgactgccatctacgagagcctcctgtcgctgagccctgacgtgcccgtgccacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaa

SEQ ID NO: 452073 - DNA, 1813 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaaaaaaaatagaagaaacaggaatgaaacacatttgggcggcctggccttggaaaaaggtttaagg

SEQ ID NO: 452074 - DNA, 1462 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgaccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaa

SEQ ID NO: 452075 - DNA, 1533 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagctgctgaaatgggtatcctctagagtacctcagcatca

SEQ ID NO: 452076 - DNA, 1877 bp, Homo sapiens
  misc_feature (1813)..(1813): n is a, c, g, or t
  misc_feature (1861)..(1861): n is a, c, g, or t
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaaacagtacaagaaaactacaaatcaatatcctttttgaacaatgatgtaaaactcctcaacaaaatacttgcatactaaattcagcagcatattaaaaggattatacaccatgaccaagtgggatttattcctggaatagatgatttgacatgtgaaaatcaatcaatataaatttcattaacagtgaaggaggaaaaaagttacatgatcatctcaattgacacagagaaggtatttgacaaaattcaacaccttttcatgataaaaacacttaacaaactagaaataaaaggaaactaccttaacataataaaagctntatatgaaaaaccctcagtaaatatcatactcagtggtgaaacaccanaagcatttaagaatca

SEQ ID NO: 452077 - DNA, 1297 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacaccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaaa

SEQ ID NO: 452078 - DNA, 553 bp, Homo sapiens
  misc_feature (492)..(492): n is a, c, g, or t
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaataaaaaaagnaaatatataaaaaattctaaataaagggaaaataaacctaaagatataataaaattaataa

SEQ ID NO: 452079 - DNA, 963 bp, Homo sapiens
  misc_feature (771)..(771): n is a, c, g, or t
  misc_feature (809)..(809): n is a, c, g, or t
  misc_feature (852)..(852): n is a, c, g, or t
ccaccaagggcgttgtgaataatcttactaatctgtgccatttgtaggttaaaggctgcctcttctccctgtggtttggtttaaaaagcattttcattctctctttgtttactgcacaggtggtacaatttcatggtagaatcatcagaaaggagaaggatatcagatgagggaagaaacaagagagtaattgctcccctggtcctactccccagagagaaccacttttacctttttggtgtgctgcttttccaggctctcttctctccctctctctcctttgctcacccccaccccgccttcccttttaacacaccgttatagaatggttcatgtatgtggtgtttcttaacctgctttttcagcaactaaaaccaaacaaaaatcaacccattgaacttctttccatgttatcaacaggcttatgaaacgtcatcttcagtgcctgcagagtgctccagtgtatccgtggaccttaacatttctgtaatcattcccgcattggtggacattcaggtggtgcctagttctttccctgtgttaagaccaacattgcgtgctctgtgctttgatgagtgaatccttccttgtcaagccaaatctttgctagcatcccggtggtctccttaactgcggacttgcaagatccacatatagacattttaaagacttttcctgtgtgttgccaaaaggcccccttcataagcattgtaccgatttgcactcgtgccggccagcgcagctagtaagagtatgccgttcccttgatanttctgtacttgaatgatcgttttttcctccttgttttntctggtgtgggtggtgtttgccaattgcggctccaaggtgttncttgccttgaagttgctgaacaacatggttgacccatcctggcttttctgctttcttgtgacgaagtattcggcttgacgacttttgcccacttgtttttaactcgaacac

SEQ ID NO: 452080 - DNA, 909 bp, Homo sapiens
  misc_feature (717)..(717): n is a, c, g, or t
  misc_feature (755)..(755): n is a, c, g, or t
  misc_feature (798)..(798): n is a, c, g, or t
ccaccaagggcgttgtgaataatcttactaatctgtgccatttgtaggttaaaggctgcctcttctccctgtggtttggtttaaaaagcattttcattctctctttgtttactgcacaggtggtacaatttcatggtagaatcatcagaaaggagaaggatatcagatgagggaagaaacaagagagtaattgctcccctggtcctactccccagagagaaccacttttacctttttggtgtgctgcttttccaggctctcttctctccctctctctcctttgctcacccccaccccgccttcccttttaacacaccgttatagaatggttcatgtatgtggtgtttcttaacctgctttttcagcaactaaaaccaaacatcttcagtgcctgcagagtgctccagtgtatccgtggaccttaacatttctgtaatcattcccgcattggtggacattcaggtggtgcctagttctttccctgtgttaagaccaacattgcgtgctctgtgctttgatgagtgaatccttccttgtcaagccaaatctttgctagcatcccggtggtctccttaactgcggacttgcaagatccacatatagacattttaaagacttttcctgtgtgttgccaaaaggcccccttcataagcattgtaccgatttgcactcgtgccggccagcgcagctagtaagagtatgccgttcccttgatanttctgtacttgaatgatcgttttttcctccttgttttntctggtgtgggtggtgtttgccaattgcggctccaaggtgttncttgccttgaagttgctgaacaacatggttgacccatcctggcttttctgctttcttgtgacgaagtattcggcttgacgacttttgcccacttgtttttaactcgaacac

SEQ ID NO: 452081 - DNA, 103 bp, Homo sapiens
gtgatctgcccaccttgaccttccaaaatgccaggattacagtcatgagctaccatgtccagctgttagttgtattttgacctatagtcttgcagaagactgg

SEQ ID NO: 452082 - DNA, 4269 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatca

SEQ ID NO: 452083 - DNA, 2474 bp, Homo sapiens
tttgaatacttggatgctaggggatatagaggcactgagagataggtgtcctccaaggatctattctggatctttctctcccttctttaacccttttctcttatctcccttttctttctcctgggtagttctgtagcttccactgtcacctccagtgtgttttcccagctcttaccttcatctggagaccagtcttgagttttcatcctttgggcagctatcttccaccagtatctacaattcagtctgcccaaagcacatcttcttcctatgctactctctttctgtgcttatgtgaaaccaccattttctctctggcaacttagcagccaagagaaatggctgagtcttcaaggatgaatgtgacgtggtacccaaggtcatttgatgtttctacccttaacacctgtttgtcacccttcttgcacttgagcaaaactaaactgctggtccctgtacttcccatttttcccatttatttctttcccaatagttccaccaattagaaatgtcctaattcttcccactcccttattcgtcagatacatttttaagtttaggctcaaatgccacctccccagagtttcctctgatacctctttgcagctagaaatgatctgtctttctgggaactcccatagcttcatactcatatctatctatactgcttatggcacttctcactgtctactgtaccttttaactctttatatatgtctcctccgatgcgagtgtaagctccctgagattagttaacgaatcttttaagttcccgtattagatctgtcgcagtgccttgaatatacaagcattcattcagtagatatatgaatgaatggattaatgggtgatttcttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatca

SEQ ID NO: 452084 - DNA, 888 bp, Homo sapiens
agcggacgctgtcaggttctctgagctgtgattatgtgttcagaaggcagtctcagtgaacttctcaaagtgagaaggttgtagcttttaatacagtctcagaagcctatgggacaaagttttctggacacggttcatcccttcttgttgctctgccctgaaaataacctggctagtcaccctttcaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacgggtcagattactgcaattctggaccccgcaagactatgttggaagaaactggaccgaactttgaatgcttctggtaaaaaactttcaggccaaagtgaatgcccttaaaaaccc

SEQ ID NO: 452085 - DNA, 628 bp, Homo sapiens
tcatgttattataaaaattaagagctggaagcataatgataggattatccgagttgtattatggtggtaggactacctatttataattggtttagtttccagatagtctatagtgtgattatattaatattgtaggtaaaaaatgcatattctgaaagtactaatatttctggcactaagaaaaactaaccagctccctgtgtggtttaggatcagctgctgctctctgaaaagccacagttgtgtcagctatgccaggaagacggcagcctaacaaaggtaactgtgatgagaaacggacaggcttttcatagggatgtctacagcagcccccagtccctccccaggagtaacagggactttcccgcatagagtgcagagtgcatgcagagtgctgggagtggggtgaaaagcaaaaggggcaagcatttactgggtacctgttttttcagtcataataattcatgtcagaaaattcccattaaaataaacataaatagccaggcgcggtgactcacgcctgtaatcccagcattttgggaggccgaggcgggccgatcacaaggtcaggagttcaagaccagcctgatcaacatggtaaaaccccgtctgtactaaaaatacaaaa

SEQ ID NO: 452086 - DNA, 7868 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452087 - DNA, 7922 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagactcttgggaggatttgacagatttggtggagcaaatgcgcgatgatacagaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452088 - DNA, 7194 bp, Homo sapiens
tttgaatacttggatgctaggggatatagaggcactgagagataggtgtcctccaaggatctattctggatctttctctcccttctttaacccttttctcttatctcccttttctttctcctgggtagttctgtagcttccactgtcacctccagtgtgttttcccagctcttaccttcatctggagaccagtcttgagttttcatcctttgggcagctatcttccaccagtatctacaattcagtctgcccaaagcacatcttcttcctatgctactctctttctgtgcttatgtgaaaccaccattttctctctggcaacttagcagccaagagaaatggctgagtcttcaaggatgaatgtgacgtggtacccaaggtcatttgatgtttctacccttaacacctgtttgtcacccttcttgcacttgagcaaaactaaactgctggtccctgtacttcccatttttcccatttatttctttcccaatagttccaccaattagaaatgtcctaattcttcccactcccttattcgtcagatacatttttaagtttaggctcaaatgccacctccccagagtttcctctgatacctctttgcagctagaaatgatctgtctttctgggaactcccatagcttcatactcatatctatctatactgcttatggcacttctcactgtctactgtaccttttaactctttatatatgtctcctccgatgcgagtgtaagctccctgagattagttaacgaatcttttaagttcccgtattagatctgtcgcagtgccttgaatatacaagcattcattcagtagatatatgaatgaatggattaatgggtgatttcttatattcagatgattcttaaccagtaagggtcctgaacagcagtgcatattaatgttaactcaaaacttaatggcaaatttataaataaacctgaaacctcttacatagccaaatacaaatgtatcagtctacctaggaaagatggttaggtacttgctcataaacagttatatgtttatgatttaacaaaatgattttactgttcataaattgtgcttttgaaatgaaatgtatcaaatttcttttcaatgatgttttgacttggaatttaaagcaaacagaaagagaataatgacttatctctttgagtattaagctgacttattctcttgctatttttgtgtttcctgtttatccattttctcattctcctttcacttcattgtcatttttattttatttagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452089 - DNA, 7810 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452090 - DNA, 7347 bp, Homo sapiens
cgggggcacggaccgagagggcgaggcggggccgccgccggcctcccccggccgggcagtcggagcccgactcgccggtggccgcccccttcttcctgctgtaccccggcgatggaggcgccggcttcggagtgcgcccgccgccgcagcagcagcgctcctggaggaccccgccgtcccccggctcaccgctgcccttcctgctgctgagctacccgagcggcggcggcggcagcagcggcagcggcaagcaccatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452091 - DNA, 7875 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggtaacagagcctcctgtttcaaaacatcttgtatgaattatgaagttggttgtaccgtgcctagccagcaaataagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452092 - DNA, 7281 bp, Homo sapiens
agcggacgctgtcaggttctctgagctgtgattatgtgttcagaaggcagtctcagtgaacttctcaaagtgagaaggttgtagcttttaatacagtctcagaagcctatgggacaaagttttctggacacggttcatcccttcttgttgctctgccctgaaaataacctggctagtcaccctttcaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452093 - DNA, 6881 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452094 - DNA, 5775 bp, Homo sapiens
tggacactggagtctggaataaatgctgtttgtcacatcaaaaaaaaaaaaaaaaaaaaactcgttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452095 - DNA, 6073 bp, Homo sapiens
tttgaatacttggatgctaggggatatagaggcactgagagataggtgtcctccaaggatctattctggatctttctctcccttctttaacccttttctcttatctcccttttctttctcctgggtagttctgtagcttccactgtcacctccagtgtgttttcccagctcttaccttcatctggagaccagtcttgagttttcatcctttgggcagctatcttccaccagtatctacaattcagtctgcccaaagcacatcttcttcctatgctactctctttctgtgcttatgtgaaaccaccattttctctctggcaacttagcagccaagagaaatggctgagtcttcaaggatgaatgtgacgtggtacccaaggtcatttgatgtttctacccttaacacctgtttgtcacccttcttgcacttgagcaaaactaaactgctggtccctgtacttcccatttttcccatttatttctttcccaatagttccaccaattagaaatgtcctaattcttcccactcccttattcgtcagatacatttttaagtttaggctcaaatgccacctccccagagtttcctctgatacctctttgcagctagaaatgatctgtctttctgggaactcccatagcttcatactcatatctatctatactgcttatggcacttctcactgtctactgtaccttttaactctttatatatgtctcctccgatgcgagtgtaagctccctgagattagttaacgaatcttttaagttcccgtattagatctgtcgcagtgccttgaatatacaagcattcattcagtagatatatgaatgaatggattaatgggtgatttcttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452096 - DNA, 5611 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcagaacaggtgaggtctactatacagggagaaaacacaaaccggccagggggcgggacaatcgcccaaggaggttaatataaggggggttaagcggcaggcccggtct

SEQ ID NO: 452097 - DNA, 6117 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaatgtcctttctctggaattggaattcagaaagcttcacgtacttcaacattccccaaatccgatcaacatgctttgtgatcaaagaattaggaaattagagcccaagatcccagataaatagtaattattagccaaaataacactaataataatatgtaatatttcctgaattcttactgtgtgccagatactttaggcacttcacatgcaaactctcctaatatcttcatatcaaccctattagtgatattattgcctccactttcagattaaagtagagcttaaggctgggcgcagtggttcatgcctgtaatcccagcactttgggaggccaaggcaggtgtatcacctgaggtcaggagttccagaccagcctggccaagatggtgaaaccccatctctactaaaaatacaaaaatttgccagacatagtggtgggtgccagtaatcccagctactcgggaggctgaggcaggagaattgcttgaacctaggaaatggaggttacggtgacctgagatcatgccactgcactccagcctggcaacagaacaagactccatctcaaaaaaaggtagagattagacaggttaaatgtgtccagattcacacagttaagcttagaagtagcaacattatcatttaaaaacctgtctctctgacagcaagcccttaaccattcgtaattactgcactttaagacaaggggttggcattctttagagaatatgtctgtatagaattccaatttttcatccttttcctctccaacttacctcaggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaaggtaactgtgatgagaaacggacaggcttttcatagggatgtctacagcagcccccagtccctccccaggagtaacagggactttcccgcatagagtgcagagtgcatgcagagtgctgggagtggggtgaaaagcaaaaggggcaagcatttactgggtacctgttttttcagtcataataattcatgtcagaaaattcccattaaaataaacataaatagccaggcgcggtgactcacgcctgtaatcccagcattttgggaggccgaggcgggccgatcacaaggtcaggagttcaagaccagcctgatcaacatggtaaaaccccgtctgtactaaaaatacaaaa

SEQ ID NO: 452098 - DNA, 2731 bp, Homo sapiens
cgacagagcgagactctgtctccaaaaagaaagaaaaatattgtggcactggggcatcaacttgattgaacgtccagaggattatagtctgctgtatatggccatccttggttttaccagtttttcagagctcagtctggggaaaagaaaaaaaaaattatacttcccctaagaagtaactgatatctggagccaactttgcaagtaagtagaatacattctgaattttatttgaatctcaagaattaaaatattactttgaaaatcatttgtcacaaactgtcagaataattaagaaactacttagagcaaagaatgaggaaacatagcttgaaagttagatcccttccctaataaaaaaagctacttagctttatacccaaactaaggcattgcagaagaaaatatttgcaatatcattatttagcattctgaataattaataaattgggctgttttcttttggcaggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452099 - DNA, 2674 bp, Homo sapiens
cgacagagcgagactctgtctccaaaaagaaagaaaaatattgtggcactggggcatcaacttgattgaacgtccagaggattatagtctgctgtatatggccatccttggttttaccagtttttcagagctcagtctggggaaaagataagtagaatacattctgaattttatttgaatctcaagaattaaaatattactttgaaaatcatttgtcacaaactgtcagaataattaagaaactacttagagcaaagaatgaggaaacatagcttgaaagttagatcccttccctaataaaaaaagctacttagctttatacccaaactaaggcattgcagaagaaaatatttgcaatatcattatttagcattctgaataattaataaattgggctgttttcttttggcaggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452100 - DNA, 3743 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatca

SEQ ID NO: 452101 - DNA, 2731 bp, Homo sapiens
atatatggccagtgaaccattggagttttacacattgggaaacataaatgctaactattttgatagcaaaaaggaatgtaaaatataacttcaaatctatttttaaatgggaacccttatataataagtcaagggtcagattctagtgattcattttaagaagcaaagtttcctctccttggaggtcaaaattaataattatgttgttctaagtaatataaaagacctacagtatttcttgtttgaaaaaaatgtttgtattctgagctttttattgaaatgatataaatgaaaatacatgaagttcctatttgtcacaattttttacttctccattgtaggctgcaaccccaccctatggatgaacaggtaacagagcctcctgtttcaaaacatcttgtatgaattatgaagttggttgtaccgtgcctagccagcaaataaggtagcatgggcggaagatgagtgaatacagtgtgccatccttctaacaataccctgaacaaatatgtattgcctgaagctcacacaggaagtagcacagctttgagcagtttactaagatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452102 - DNA, 1779 bp, Homo sapiens
cgggggcacggaccgagagggcgaggcggggccgccgccggcctcccccggccgggcagtcggagcccgactcgccggtggccgcccccttcttcctgctgtaccccggcgatggaggcgccggcttcggagtgcgcccgccgccgcagcagcagcgctcctggaggaccccgccgtcccccggctcaccgctgcccttcctgctgctgagctacccgagcggcggcggcggcagcagcggcagcggcaagcaccatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaaggtaaaagtcctgtttctttaatgaaacactttggattgtcagtgctgaagtgaaaagaatgtgctgtacattcggcaaatagaaaatacatgaaattcttccaaattagcatcagacattctggtagaaaaaagccagttgaatgttatgtgtgttttctaaggtatgactgaaatgtttttaggaaatgtcaatcacttgactagcctttaaaaaaaaaaaagaaaggtcagccttttatgactgttttgaacatcagaactcttaatccatgtcagagtcatgtgttagaggaaggatacttaaaagcatggaaggactcttaaatgtatgtatgtaattctgtgattttattgttcatcact

SEQ ID NO: 452103 - DNA, 6978 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452104 - DNA, 4417 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagattgcgccaggctgagcgaagccgccaatctgctgagttggacaaccggctcttcaaacaggactttggagacaagatcaacagtctgcagctggaagtcgaggagctcaccaggcagcggaaccagcttgagttagaactaaaacaggaaaaagaaagaagattacaaaacgacaggagcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattctaccagcccatcataagactggaggccaagacctggaccaaaacgtttatgcaggctcctctgtacctgtgttttagctgtcaggatctcatagagcccagttcttagagtcaactaaagagttgataggaatttactaggtccagggagaaaaggcagtggttggggttactggaaattttgctcattttctctaatgactgtatgaataaaagtgaacttacttgagcctttctcttctaaatctaaacaacctgatattgaaggtttgctttatagcatatctttggaaaggcaactcatttttatgattagtgatactggggtggatttaataggagagagaatccaggcagataagaataaaaaggaaaatgatcatctccttctatagcatttgcagattcaagggggagaggtagatgctgagatcaaaatgacagttgttacttatttttccaggtgctgttagtataaacattgtttcctcttcacccctgctaactacctctttaaagtatttctaccaaactgtgaacccaatctcagggaaaagaaattaaaaagtaatataaattctgcatatattaaaaacaatattgtaatatgttataatttcaggaccagaattttctggtctttacctacaagggttttcattatcaaaaaaaagaacatttgtttttctactttatgacttcaaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaaggcaaaaaacattacataatattttgattctgttacgtgtgtctatagattgtttcattctaatcaagacctaagaaggtatgattctgtgactgatttagaattctggggtggaaatatcctggaaccatgttttttaataaattctgtctcttggaaagagttaacaacagcctgggaaagagttgttattccaaaagtcagcctgttacttggtgaagctgaagtttaagagttctggggaaaaataaaatctagtaattccag

SEQ ID NO: 452105 - DNA, 4780 bp, Homo sapiens
agccattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccattttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaatagggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcagcttttcctctgcctggttcaccttcatcttacttttctttagaatttgtttcttctccatcttttcccccccataatttcttcacctgtgtcctgcaaagtttttttcctctctctgtctctctgtgcattcttccttgggttattttattttgtgttgtgaacttggtcttcttccccaccatggcttttgttttttatcacaagttcatgtggctcacatccagattgcgccaggctgagcgaagccgccaatctgctgagttggacaaccggctcttcaaacaggactttggagacaagatcaacagtctgcagctggaagtcgaggagctcaccaggcagcggtgaagagggggtagcttgagctgacagggtggtcatgggtaattcttagggtagacagcaagaaaaggggtctcatgacttccagccaggttggctctgtctttgcaagtcgctatcacgaaatacaccttcatatattgcgtgcggggggatgattcgttgt

SEQ ID NO: 452106 - DNA, 1690 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452107 - DNA, 757 bp, Homo sapiens
catggccaggaggcccagattcagacccagggctgtctgactccaagcccatgcccttaactagcacactgtgccaatttctatctttttggacaatttaaccttaccctggcttgggaatcccagtgacattgatgttaagggtcttcttcctgtgtaaccttaggaaagtcattcagcttccccaagccttcgttattatgaaatatataaacaaaactcatacctacagtttaaagaagaaataatgaacacccatgaatttacagcgacccagcttgagtaatggagcttcagtttcttatctgtgtaatggaattttagactggagactctgagtttatgtcaaagagcaacctctgtaactgcaggaattaaaggacaaggatagccttggtgtcagtcagcctttttgccacatccaaaataccacttcagggacggctgattatcactaagaaccccccctccagtccccccaccacctgtacacttcacacacacatcctcctgtctttgctaacactcagcaccagccacagccacaaagcttgcccagcaggtaaggcctggcctgctggtgtagtaagggactggtttgccacagtggatgggaaatggaccccaccccacccctaacctattccctgatggaaaccatagagtttccagtctccaacccagtgtctcccttctgactttgatcaatgaggtcatccattggactccagcctgggcgagagtgagactccatctc

SEQ ID NO: 452108 - DNA, 622 bp, Homo sapiens
ggccagtctggtactggaggagttcagagaaagaaggaatctctggacatctgcggtgcttcactgaggagacaagcctcgtataggagagttggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaaga

SEQ ID NO: 452109 - DNA, 2822 bp, Homo sapiens
agatgtgtctgtcttccacagggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452110 - DNA, 2898 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctattgcagcctgttcccggggcgcttgcttcctctgcccgttctctatacagacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452111 - DNA, 2622 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452112 - DNA, 2749 bp, Homo sapiens
cgactttgacttggacatgactgaagaggagatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggcttgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452113 - DNA, 2626 bp, Homo sapiens
catggccaggaggcccagattcagacccagggctgtctgactccaagcccatgcccttaactagcacactgtgccaatttctatctttttggacaatttaaccttaccctggcttgggaatcccagtgacattgatgttaagggtcttcttcctgtgtaaccttaggaaagtcattcagcttccccaagccttcgttattatgaaatatataaacaaaactcatacctacagtttaaagaagaaataatgaacacccatgaatttacagcgacccagcttgagtaatggagcttcagtttcttatctgtgtaatggaattttagactggagactctgagtttatgtcaaagagcaacctctgtaactgcaggaattaaaggacaaggatagccttggtgtcagtcagcctttttgccacatccaaaataccacttcagggacggctgattatcactaagaaccccccctccagtccccccaccacctgtacacttcacacacacatcctcctgtctttgctaacactcagcaccagccacagccacaaagcttgcccagcaggtaaggcctggcctgctggtgtagtaagggactggtttgccacagtggatgggaaatggaccccaccccacccctaacctattccctgatggaaaccatagagtttccagtctccaacccagtgtctcccttctgactttgatcaatgaggtcatccattgggctcctacctggtttttattgttttttttttgaggcggagtctcacttccagcctgggtgacagcaagactccatctaagaaaacaaaaaaaaaaagtacgattggtgcgccagagtgaacacaaaatgtaaagacttgtgtatttgtgagacccttttgaagcatgctatctccccagctacaccctcttcaggtgccccttccctgcctcctcctgcttttcacactgtggctcgtggttccaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452114 - DNA, 1894 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452115 - DNA, 2053 bp, Homo sapiens
gtacagatattgtcactcaggtactaagccaagtactcaatggttattttttctgatcctctccctccacctgccttccatcctcaagtaggccccagtatctgttattcccctctttgtgtcatgagttctcatcatttagctcccacttataagtgagaatgtgaggtatttggttttttgttcctgcgttagtttactaaggatgataacctccagctccatctatgttcctgcaaaagacatgatctcgtgcttttttgtagctgcatagtattccatggtgttgtttttttttttctttgagatggagagtcgacggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagcctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452116 - DNA, 1806 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452117 - DNA, 3222 bp, Homo sapiens
  misc_feature (3012)..(3012): n is a, c, g, or t
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaaaaaaaaaaaaaaaaaaaaaaaaaaaaaaaaaaaaaaggggcgcgcgccgcctcttagaggttctcccccctccgagagggggcccccagcccttttggcgcccgttccccccttttttttgtgctacacaaggtgggcccccctatttgtgaggcgccgtttattattagcgctctgggccatggtggccccctcgtttacaacacacctgctgggcgaccgtggggcaccagcggctcgtcagcctgggggcaaccattgtggttcaaacggggcacccccccatatacctaaacccgtccgggggatccgacacacccacacttgtgggcgacccacaactatccccccccactgcggcaaatttttttaaaacgcctcncccatacgggccgcaccatttctataacccaactcttccacccagagcggggttaataaaccgggtggtgggtctacaccccaacacgcaccgcgcaaaattgttcacgtaggctagcgttgagtaaacaagaatatttacggcctacacaccgaggcatattcttgcgtacttgtctcgcacccacttttttttaccacccgcgaggcc

SEQ ID NO: 452118 - DNA, 2290 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452119 - DNA, 1719 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaaga

SEQ ID NO: 452120 - DNA, 1690 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaaga

SEQ ID NO: 452121 - DNA, 658 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagccctctacaacaagatggttccaacagga

SEQ ID NO: 452122 - DNA, 1498 bp, Homo sapiens
catggccaggaggcccagattcagacccagggctgtctgactccaagcccatgcccttaactagcacactgtgccaatttctatctttttggacaatttaaccttaccctggcttgggaatcccagtgacattgatgttaagggtcttcttcctgtgtaaccttaggaaagtcattcagcttccccaagccttcgttattatgaaatatataaacaaaactcatacctacagtttaaagaagaaataatgaacacccatgaatttacagcgacccagcttgagtaatggagcttcagtttcttatctgtgtaatggaattttagactggagactctgagtttatgtcaaagagcaacctctgtaactgcaggaattaaaggacaaggatagccttggtgtcagtcagcctttttgccacatccaaaataccacttcagggacggctgattatcactaagaaccccccctccagtccccccaccacctgtacacttcacacacacatcctcctgtctttgctaacactcagcaccagccacagccacaaagcttgcccagcaggtaaggcctggcctgctggtgtagtaagggactggtttgccacagtggatgggaaatggaccccaccccacccctaacctattccctgatggaaaccatagagtttccagtctccaacccagtgtctcccttctgactttgatcaatgaggtcatccattgggctcctacctggtttttattgttttttttttgaggcggagtctcacttccagcctgggtgacagcaagactccatctaagaaaacaaaaaaaaaaagtacgattggtgcgccagagtgaacacaaaatgtaaagacttgtgtatttgtgagacccttttgaagcatgctatctccccagctacaccctcttcaggtgccccttccctgcctcctcctgcttttcacactgtggctcgtggttccaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaaga

SEQ ID NO: 452123 - DNA, 816 bp, Homo sapiens
ggccagtctggtactggaggagttcagagaaagaaggaatctctggacatctgcggtgcttcactgaggagacaagcctcgtataggagagttggtgagtttggggcaggtgcaggggagtggtagtctaagctgaggaggcctacaaagactagctagcaaagggcatggggcatgtttaaggcgcggtgacctaaacccactcttctgtattctctcccaggagaaggaggtacaagaagggtgagtgggttgactcagaaatagaacttcagaatttaaaaccttaagctggattcagaaggttggccttggggccataaagcagcagagcatggatgctaaggctgtgggttctggagttcagacagttctgggttcaaatcccaactttgttcataagtcatgtgacttcagaaagattactaatcttctctaagcctttgtttgctcctccataaacgggataattgtttcatgatagatcctcagtcagagcagaattaagtagagccctgctttggggaaatgaaaatagaggtaacattctctgagcactttctctgtgtctagatctgtgctaagcacagatgcatatgcacagtaatatgcatattactcaatccttacaaaagccctgtgagatctgtgtactttttctcatatttctagtggtaggaacctgagatcagtgacccacccagtaaatatttcagtgtgaaatagtcctgtagaagagggaggagtaggtggtgggcctgacaggtgtaatagggttgctgggtggatggtcccagggcccactgaggttgtgat

SEQ ID NO: 452124 - DNA, 505 bp, Homo sapiens
ttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaaggtgtctgggggtctgtttttgtccccttggcagctgcactgggccagggcaggactggcttcccacttggagccagagacagggtagggggatagcctaggtccagaggacgtaccttgtcctcatcccagattcagctttgcctttgggatgagaaagggtcagggctcgcaacaggcctctcactggga

SEQ ID NO: 452125 - DNA, 2847 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452126 - DNA, 3238 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaaaaagaaaactgcagaaacaacaacaacaaggacaaaaaaacaacaaaccacatacgggagcgtagcacatcactctccgcgggggcccgaaagtcaaaacaccgtcgcaccggaagcgaagaacagacgtgccggaacatgtatgcacaaggaggcacccgccgcggcgagaggaacacaacaggcggccccgcgggcacacaaacaagtcggcgctacgcgaacgacgcagcgaggcagagcaggagaaagaccacatcatgtgaggagcgaaagagaaccaagacacaaaagaggaagcagaaaataaacataaaggcgagcgcggcgacaccgaggtgacggcaacagacacagaagcacaacaacagcggcgcgcgagcacgcagcc

SEQ ID NO: 452127 - DNA, 2854 bp, Homo sapiens
cgactttgacttggacatgactgaagaggagatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452128 - DNA, 2813 bp, Homo sapiens
  misc_feature (38)..(39): n is a, c, g, or t
  misc_feature (67)..(67): n is a, c, g, or t
tcggattggacggctcgggagggaggagtgggatggtnnggactggtgcagcagactcaagcagcangagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452129 - DNA, 2489 bp, Homo sapiens
tcatgcacgagggatgggatcgtggcgttatggcatgcagcagagctaccaagcagtcaaagagaagtcctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452130 - DNA, 1767 bp, Homo sapiens
ccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcgtttttagttggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452131 - DNA, 2643 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggctcaagcacggacatcagtgaggactgggagaaagactttgacttggacatgactgaagaggaggtgcagatggcactttccaaagtggatgcctccggggagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452132 - DNA, 1445 bp, Homo sapiens
agcggagtaaatagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgactgcgatgtcatcaccctgatgggcacaccgtctggcacagctgagccctatgatggcaccaaggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggcggaacagagcatctctgaagagcccggctgggaggaggaggaagaggagctcatgggcatttcacccatatctccaaaagaggcaaaggttcctgtggccaaaatttctacattccctgaaggagaacctggcccccagagcccctgtgaagagaatctggtgacttcagttgagcccccagcagaggtgactccatcagagagcagtgagagcatctccctcgtgacacagatcgccaacccggccactgcacctgaggcacgagtgctacccaaggacctgtcccaaaagctgctagaggcatccttggaggaacagggcctggctgtggatgtgggtgagactggaccctcaccccctattcactccaagcccctaacgcctgctggccacaccggcggcccagagcccaggcctccagccagagtagagactctgagggaggaggcgcccacagacttacgggtgtttgagctgaactcggatagtgggaagtctacaccctccaacaatggaaagaaaggtaggtctggaggtccaagcccagagggttgtgtgcggtcagggccacctcctgaggcagatttgtctccttgtcccttgttaggatactatgagcagattttttttcgtttctgataatgatgacagctgctatatattgactatttgctaacatatttcattctaagttgcacaacatctctgaaataagaatgcatcttcaattgttggcatcttaagagtcaacaaaacaagtttgatgccagatcccat

SEQ ID NO: 452133 - DNA, 673 bp, Homo sapiens
agatgtgtctgtcttccacagggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452134 - DNA, 638 bp, Homo sapiens
agatgtgtctgtcttccacagggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctacggaaggctcctcaggagcaacagagaagatgaagaaagggttatctgacttcctaggggtgatctcagacacctttgccccttcgccagacaaaaccatcgacagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 452135 - DNA, 2887 bp, Homo sapiens
  misc_feature (2072)..(2072): n is a, c, g, or t
aagcgcctcgcgggggtctggcccggagtggagggcgcgcggtcccagccctcccgctcggccggcgggtgtcgagttcagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctccncaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaattaccca

SEQ ID NO: 452136 - DNA, 2968 bp, Homo sapiens
  misc_feature (2153)..(2153): n is a, c, g, or t
ctggcctcccgaaggcgggaggaggggagccgggggctgggctgagaaaggaccctgggtagggagcagtgcgagggagacagcgccctcagagggaggactattgggaggcggcaggagggacagcgaacgtttcctcctctgctcctgaatcggaggaagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctccncaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaattaccca

SEQ ID NO: 452137 - DNA, 2917 bp, Homo sapiens
  misc_feature (2102)..(2102): n is a, c, g, or t
ggctgggcatcggggctggctggcatcgccggggagccgacggcgacggggagccccgcgggcggggagggcggcgcagggcagcgggtgcggtgacacctgtgggcacagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctccncaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaattaccca

SEQ ID NO: 452138 - DNA, 471 bp, Homo sapiens
cccctccataggagcaaggcttctgagccaactcttaggtcgccaccccacccccagggtgaaatgggatctgcaatgtcctgacaacggtccagctgaattatcgatggtgggagagtaagtccagagcagcaggccccagtagcactgtggatagagggagctcagagagctctgggtcagtgtcgggacctcaggctccttcgtggaatccagagaaaggggcgtagcctcgagagcattcctgggaggatcctgggagggagggactgtcaggagctgggctaagggcccctgcgaggctctcttcacctgctcctgggtcctgcagctagagcctgtattcatggccttctccccatgcctgctccccacctcccgtatctgtctctccagtttggccagcggttccacccctatgtccagtactgcctccgagtgaagcagaccatggcttacgcccgagaacag

SEQ ID NO: 452139 - DNA, 367 bp, Homo sapiens
ccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggtgagtccaggctgtgccccaaaagtgacctggtggggcaggagggaagacacctaggctgtggagtctctgtccccttacaggttcagaggttgagctattcctgccccttaccctactcttctttcctgggttgcgggaaagaggagggcagtgacagg

SEQ ID NO: 452140 - DNA, 411 bp, Homo sapiens
cctattccgtcaggcacgtccaccactgtgccaggcgtaggggtgctgcgtgccatcgcgcgacgggttgcctcttgctgacagttccctcttcgtgtgcaagccccgtcgcgtttcctggtccgcgcttttaactcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaattaccca

SEQ ID NO: 452141 - DNA, 1852 bp, Homo sapiens
ctggcctcccgaaggcgggaggaggggagccgggggctgggctgagaaaggaccctgggtagggagcagtgcgagggagacagcgccctcagagggaggactattgggaggcggcaggagggacagcgaacgtttcctcctctgctcctgaatcggaggaagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggtatgggaaagccagcaacggggaggcatgggcaggggtccccggagctcagaaatgggagcacagtggtggatcacacctgtaatctcagcactttg

SEQ ID NO: 452142 - DNA, 1457 bp, Homo sapiens
cccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcctcgcactaccgggccacaatcggcgtggacttcgcgctcaaggtgctccactgggacccggagactgtggtgcgcctgcagctctgggatatcgcaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcaatgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcaatatattctctgatggcctgacaggcctattaagtagatgtgatattttctcccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctttctctgactcaagctgtggggctcctctatacatgctatacatgtaatatatattatatatatttttgcaagtgaacaataaaacattaaaagatgctgtttccctaaaaaaaaaa

SEQ ID NO: 452143 - DNA, 1153 bp, Homo sapiens
cccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcctcgcactaccgggccacaatcggcgtggacttcgcgctcaaggtgctccactgggacccggagactgtggtgcgcctgcagctctgggatatcgcaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcaatgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcaatatattctctgatggcctgacaggcctattaagtagatgtgatattttctcccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctttctctgactcaagctgtggggctcctctatacatgctatacatgtaatatatattatatatatttttgcaagtgaacaataaaacattaaaag

SEQ ID NO: 452144 - DNA, 1434 bp, Homo sapiens
cccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcctcgcactaccgggccacaatcggcgtggacttcgcgctcaaggtgctccactgggacccggagactgtggtgcgcctgcagctctgggatatcgcaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcaatgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcaatatattctctgatggcctgacaggcctattaagtagatgtgatattttctcccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctttctctgactcaagctgtggggctcctctatacatgctatacatgtaatatatattatatatatttttgcaagtgaacaataaaacattaaaag

SEQ ID NO: 452145 - DNA, 1249 bp, Homo sapiens
ggaagggtacagtgattaatagcccaaattccagagttgaactgcctccatctggatccttactttactctgcatgtagtaggcaatcttaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcaatgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcaatatattctctgatggcctgacaggcctattaagtagatgtgatattttctcccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctttctctgactcaagctgtggggctcctctatacatgctatacatgtaatatatattatatatatttttgcaagtgaacaataaaacattaaaag

SEQ ID NO: 452146 - DNA, 1032 bp, Homo sapiens
agctgacatggtagcgcacgcctgtagtcccagctactcaggaggctaaggtgggaggatcacttgagcctgggaggcagaggttgcagtaagctgagtaagccaagatcatgctattgcactctagcctggatgacagagtgagaccttgtctcaatgaaaaagcagggggcactgggaggggagaaccaaatgccctatcctccagttctcagcatatagaagggagctctctcatctgctagccactcctgcctcactgtgccatgctttctgtaatgcactctgggtccagggactgcttggcaggaggtgggaagaacaagaagtttagggccttcccagtttcttagggcctgtctggagagggaactagcgtttactgagtttttacgatgtgttacacaccatgtaaagccctttacctacattatttcttataccccaaacagagagcaaataagtatccccattttttagtcacatagagttccagagttgccacagttacatcgcaaagtcaggatttgaatccagtgcagaccgcaaacaccatggttttctctccaaagcagagcagctccagaggtggaggtgactggaatgtcctagattcagtgggaccaggagctgggggtgctagcagaggctctcatctccccagggtcttgtcagtcagagtcctaaacccttcaattaactatccctctaatcccagctgaagcctgggtaatacctcccaccaagaggtatctgtgtggaacctggccctatttagggattaggtgatggagataaatttccatggcaaacggccctcgtccccgttcgtttgcagagcacaacaatccagattaaggtacagagtttgggttttatttggagattagttggtattacaggtgatggtgataccaaaacccaatgctgctatacctgcctccatcccagatctgtcaggttgtctccacagccccacatcagagggcatccaatctgatctttgtgaaaattaaatcaacataagcccca

SEQ ID NO: 452147 - DNA, 473 bp, Homo sapiens
aggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452148 - DNA, 5718 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggaggtagagccagcctggagacactcagaggttggagggctctattgcaagggctggactgtatagagcatttggaaggctcaggatgaaaagtggaggtcagagagtggaaggggctgcagaggaggggtctggaattttcagaggtgggagggtgagctgtttgggaggagccagctgccagctgtgagaggatcaggatggagggtatgtgtgcagagagacccccacccctaccaagtgctccctggggcctctgggtcggcagggctgtctgcagtgagagcttctccttgatggcagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccggcccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452149 - DNA, 5696 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccaggtcaggaggaaggggagcttgtgggcttagagtggcatcagaatatgaaacccaagcagtggcgggtaagggctgtgttcccatggctgggaacagcaggtgactctagtgaacctggggcatttgttccccttcccctctgccccatctgggcctgctctgctggtgctgtagaggaagtcccactgctgcatggtctctccttcatccgtgtttccgtgtgtgtctccgtgttccttctgcccctgtgccccttctctctgatgttctggctgcagatggtgctgggccagatcgaagaccacagacgaacccaccggcccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452150 - DNA, 3055 bp, Homo sapiens
ttttttttaaataggtaatacattcacatggttcacaaatcaaaacgctctaacaaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccggcccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452151 - DNA, 4020 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452152 - DNA, 2924 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccggcccatcaacatccctttctttgatgtgttcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452153 - DNA, 2638 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggaggtagagccagcctggagacactcagaggttggagggctctattgcaagggctggactgtatagagcatttggaaggctcaggatgaaaagtggaggtcagagagtggaaggggctgcagaggaggggtctggaattttcagaggtgggagggtgagctgtttgggaggagccagctgccagctgtgagaggatcaggatggagggtatgtgtgcagagagacccccacccctaccaagtgctccctggggcctctgggtcggcagggctgtctgcagtgagagcttctccttgatggcagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgcagccaaagtggaaggtgggtgccagacacagcagctgagctgacacaccttcagggcagtagcacaggagagatgtctgtgctgatttttatgcaatcctttctggaagtgatgccaccttagaagctgcaacttagagagaagcaacaaacggagaagcaggcattgtgttccctcaaagaatgaaggaggatgtaaagttagaaaattgcaagagaattttgaagacttaaaaaagcccccacatttagctttttctcttgtacagaaacatattccatgctttgaaataaagggaagtgctctcctgttttcagatga

SEQ ID NO: 452154 - DNA, 2794 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggaggtagagccagcctggagacactcagaggttggagggctctattgcaagggctggactgtatagagcatttggaaggctcaggatgaaaagtggaggtcagagagtggaaggggctgcagaggaggggtctggaattttcagaggtgggagggtgagctgtttgggaggagccagctgccagctgtgagaggatcaggatggagggtatgtgtgcagagagacccccacccctaccaagtgctccctggggcctctgggtcggcagggctgtctgcagtgagagcttctccttgatggcagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgcagccaaagtggaaggtgggtgccagacacagcagctgagctgacacaccttcagggcagtagcacaggagagatgtctgtgctgatttttatgcaatcctttctggaagtgatgccaccttagaagctgcaacttagagagaagcaacaaacggagaagcaggcattgtgttccctcaaagaatgaaggaggatgtaaagttagaaaattgcaagagaattttgaagacttaaaaaagcccccacatttagctttttctcttgtacagaaacatattccatgctttgaaataaagggaagtgctctcctgttttcagatgaagctactttgctattttaagaatataaaggccgggcatggtggctcacgcctgtaatcccagcactttggaaggccaaggcaggtggatcatgaggtcaggagatcgagatcatcctgcctaacatggtgaaaccccgtctctactaaaactacaa

SEQ ID NO: 452155 - DNA, 455 bp, Homo sapiens
gtggcccagccccgctgcacctctctcctgtctcccactttgtcccttgcctctcttcccaaaaccttgactccctctgcttcttccctccatcctcttctctccactccttggggaggccctgaatgtctcccatctgttctctgaaggcggtctctgtggagagtctgctggcgttctcagggctctccgcagacatgctcaatcaggcgattgggcccctcacctcttcaagaggccccctggaccttcacgagcaaaaggatataccaggaggtatgcacttagggccagaggggcctctgctctgaggcagggccaggctcctcgtgggctctccactgagtgagtgatcagcatttatttcaggggtcctcaagattcgagatggcagcaaggaacccaggtcgagatgggacattgtgcggctcatcccacctcagacgtacctgcaa

SEQ ID NO: 452156 - DNA, 518 bp, Homo sapiens
ctgtcccgacactcctggcctgttgcctcaatctgccacacactgaaccccagaacctgcctgccctcctacctgaggggcactttgaacagatactccaacttctacaacaagagtgagcagccaggcagagggactggggactggggagagggtgggctgctaggaaaggacctggggttgggggcagaccctgatgttgggaggcttgatgtaaaaagagatagtctttggctgggcacagtgctcacgcctgtaatcccagcactttgggaggccgaggcaggcagatcacttgaggtcaggagttcaagaccagccttggccaacatggtgaaacctcgtctctgctaaaaatacagaaattagccgggtgtggtggtgtgtgcctgtagtcccagctactcgggaggctgaggcaggagaatcacttcaacccacaggcagatgttgcagtgagccgagatcgtgccactgcactctagcctgggcgacagcgagactccatctcaaaaaaa

SEQ ID NO: 452157 - DNA, 349 bp, Homo sapiens
actttccataattgttaatattgctaatttgtacaatggttaatgatcttataaaatagttgtatgaaagcaccaaccaccttagaaagctgccagcattcatatctactttccagaccctcatccctcctccccactcacctgctctgctcgctcattcatggctttcctgtgctctgccattgctcaggtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattac

SEQ ID NO: 452158 - DNA, 295 bp, Homo sapiens
tttgagttttgcttttaaaattgaattttattttttttaaataggtaatacattcacatggttcacaaatcaaaacgctctaacaaggtatacactgagaattcttgctctcacccaaatctctgttcccccagggtcccccacacaccccttactggtaactacttgtattaatttatgtatctttcccgtgttcccttatgcaaatataagcaaacccaaatgtgtgatcttgccactctcttttttacacaaaaggatatggagatattattacataaaacattaagagctt

SEQ ID NO: 452159 - DNA, 703 bp, Homo sapiens
tgaagatagtcctgtgtgtgtttcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctaggtgtgtgagagtgtgcgtgtatgcttgtgtctgtgggaaaggtaaggctattgcaaatagctggcaggcaggggtccatagaagctgtgagatggaggtttaatatgcgtggggagggggctggagttttctgagctgtgggaggggaagaaaggataaagagaaaagatttctccagtgggctgggaatgggatataccagttagcacagagcagttctgaagtaccagggggccttcggtttgggtgctggggttagctggcagtcttaggaagggtggacactgagataacatatgcttcaagcccctgacaccttcctcctccattctcacccccaactcaacggtgctctgcgccaggagcagaattttgctgaccgcttcctccctgatgacgaggctgcccaagctctgggcaagacctgctgggaggccctggtcagccccgtggtgcagaacatcacctcccctggtaaccatcctgacatctggacccatt

SEQ ID NO: 452160 - DNA, 5418 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccggcccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452161 - DNA, 5514 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctggtgaggggcagtgtggggaggaagggaaagcaggagaagggctgggtcggctcagggactcacaggacactgtggcaggagcctctgatctcatcaggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccggcccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452162 - DNA, 5220 bp, Homo sapiens
tgaggctgggcgatgttcggcagagcaacaacggtgtgccctgtgcaggtatttgggagtcaacaggccgcacctattgggtgcactggcacatgctggagatcttgggctttgaggaagacattgaggacatggttgaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctggtgaggggcagtgtggggaggaagggaaagcaggagaagggctgggtcggctcagggactcacaggacactgtggcaggagcctctgatctcatcaggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccggcccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452163 - DNA, 2811 bp, Homo sapiens
gcggaaatgagccgtggcttttggctggcggagccgctggcagggaccgggccccaccctgccccagtggctgccgactcacgcgggtgcagctctgttccgcggaggcacgcccccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattat

SEQ ID NO: 452164 - DNA, 2683 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggaggtagagccagcctggagacactcagaggttggagggctctattgcaagggctggactgtatagagcatttggaaggctcaggatgaaaagtggaggtcagagagtggaaggggctgcagaggaggggtctggaattttcagaggtgggagggtgagctgtttgggaggagccagctgccagctgtgagaggatcaggatggagggtatgtgtgcagagagacccccacccctaccaagtgctccctggggcctctgggtcggcagggctgtctgcagtgagagcttctccttgatggcagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaaggtgggtgccagacacagcagctgagctgacacaccttcagggcagtagcacaggagagatgtctgtgctgatttttatgcaatcctttctggaagtgatgccaccttagaagctgcaacttagagagaagcaacaaacggagaagcaggcattgtgttccctcaaagaatgaaggaggatgtaaagttagaaaattgcaagagaattttgaagacttaaaaaagcccccacatttagctttttctcttgtacagaaacatattccatgctttgaaataaagggaagtgctctcctgttttcagatga

SEQ ID NO: 452165 - DNA, 2839 bp, Homo sapiens
gcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggaggtagagccagcctggagacactcagaggttggagggctctattgcaagggctggactgtatagagcatttggaaggctcaggatgaaaagtggaggtcagagagtggaaggggctgcagaggaggggtctggaattttcagaggtgggagggtgagctgtttgggaggagccagctgccagctgtgagaggatcaggatggagggtatgtgtgcagagagacccccacccctaccaagtgctccctggggcctctgggtcggcagggctgtctgcagtgagagcttctccttgatggcagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaaggtgggtgccagacacagcagctgagctgacacaccttcagggcagtagcacaggagagatgtctgtgctgatttttatgcaatcctttctggaagtgatgccaccttagaagctgcaacttagagagaagcaacaaacggagaagcaggcattgtgttccctcaaagaatgaaggaggatgtaaagttagaaaattgcaagagaattttgaagacttaaaaaagcccccacatttagctttttctcttgtacagaaacatattccatgctttgaaataaagggaagtgctctcctgttttcagatgaagctactttgctattttaagaatataaaggccgggcatggtggctcacgcctgtaatcccagcactttggaaggccaaggcaggtggatcatgaggtcaggagatcgagatcatcctgcctaacatggtgaaaccccgtctctactaaaactacaa

SEQ ID NO: 452166 - DNA, 450 bp, Homo sapiens
gtaggaccccagggccattagccattactccacccctcacaggatctgccctcctgcttctatctggccctatcctacttttttctaactcccacctgtcttgagccccacagaaagtagtgtcctttatccctgtgcttgtgccaccaggccctgaacaatgagggtggcatgaggacagctttgtcaggaccctacacatcccagggctggggaagggagggaaacagtgaggggactggagcctagagccaacttggctctgcatgtgtggaggtgacagctttctctgccccctgccaggtgaatgtgatgccctctgccagccgggtgatcctcctggagaacctgacccgcttctggcccatcatccagatccgcataaagcgctgccagcaggtggggccagggatgtggggtgtggccctgggtagggggctctgagcccca

SEQ ID NO: 452167 - DNA, 1717 bp, Homo sapiens
  misc_feature (11)..(11): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctccaaaaaaaaagaaaaaaagggaaaagcattcgggccgaattcgaactcacttgggccattggcccttaaggaggcgtattcaaatcaatgggccccta

SEQ ID NO: 452168 - DNA, 849 bp, Homo sapiens
agtgaagagaagcagagagaggtgaggctggtgtgggtgttttgacagggtgagaaggcaacaaactccaccttgatcaacccctgaaggctgaaggagaaagctggaattctaggagctactggcgggaagagagagctagtttgatgaattggaatccttcattcattggaacaagaccccagttaaggaaattttgattcactagagcttataaatgatggcaagcttgggcagtgtcccaggtaatctgtgaggccagctgcatagtgatcatgaagcctcagaaatgtgtacagaatttgggggcgttctctctccactccgggagtggagagagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctcca

SEQ ID NO: 452169 - DNA, 1705 bp, Homo sapiens
  misc_feature (11)..(11): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccgttcacttggaagccttccgggcagtgttgtagaagccaaccctaatcagcgtgaccctccgctttgggatgaaattgattctaggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctcca

SEQ ID NO: 452170 - DNA, 879 bp, Homo sapiens
gtatatatatagatagatagatagatccgccacatccagccatttttttgtgtgtgtatatatagatagagagagagagagagagagagggagatgggggtctcactatgtggcccattctggtctcaaactcctgggttcaagcaatccacctgcctcggcctcccaaagtgctgggattacaggcgtgagccatcacagctggccttcagtatctgcacataaaaagggatctgcatacatataatcttatccttcccctttctgacacatcactgcatattgaatacaccagtgtgcaccctaatcaatcttcattaccagttcacttggaagccttccgggcagtgttgtagaagccaaccctaatcagcgtgaccctccgctttgggatgaaattgattctaggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctcca

SEQ ID NO: 452171 - DNA, 1647 bp, Homo sapiens
  misc_feature (11)..(11): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctccaaaaaaaaaaaaaaaaaaaaaaaaaac

SEQ ID NO: 452172 - DNA, 1581 bp, Homo sapiens
  misc_feature (11)..(11): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattcctctaggttgctggggctctgctggttaaggaacaggaagcctgaccatctccctccactacctcttccctgtgctgttacacagtgtcattgttgatgttaaattaaagtcatattcttgcttctctcca

SEQ ID NO: 452173 - DNA, 600 bp, Homo sapiens
ccaaggagcagagagcgcaaaggcacaccaaccccagcctcagggccagagagaccagacacacgtctacctcacgtccagttctgtgttgagccaaagctcacccagaatttttctttgttgttgacctcgtgttgcgtgcaagactgggcgctcgttcaagcaagcatgtagggatttatgggtgctacaaggattgctgttgccctgggggcctcctacaaaggcgcaggcccagtcgccacgactcaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctcca

SEQ ID NO: 452174 - DNA, 1590 bp, Homo sapiens
  misc_feature (11)..(11): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggatcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctccaaaaaaaaaaaaaaaaaaaaaaaaaac

SEQ ID NO: 452175 - DNA, 1306 bp, Homo sapiens
  misc_feature (11)..(11): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattgtctaggttgctggggctctgctggttaaggaacaggaagcctgaccatctccctccactacctcttccctgtgctgttacacagtgtcattgttgatgttaaattaaagtcatattcttgcttctctcca

SEQ ID NO: 452176 - DNA, 1773 bp, Homo sapiens
  misc_feature (11)..(11): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggtacggtaccgcgcgaggcctgaacgggcccttctgctgctcggtggagtgcggggcgaggctggaggctgcccggacgggggtgaggggacgatcctgaaagtccttccgcccttccggagcggaggcctccgcgccccaagtccccgtttggggctcggtgggacagaagctgtatcaggtccacgagcccccccacctcacatgatcgtgtgtcatgaaagaaggggaacagagctcgtgacagcctagacagtgggcttggactttgttctgctttctcctcctttagaggctcaccatcgtcccgtaaggcagggatgatttttgtcctactcacaggtgagaaaactaaagctcggagagggtaaggcacacactaaagttacgagtcggcagaggcagagctagaatttgaacccaatctcaaccctttctgcctccggtaagccaggtacacactcttggcaggtctcctcaggcggcctcggaatttccttgtagtcttgagcacagtaggcagaaatgtcgggactgtgagagccttctgctaagaccttgcactcaagccctcactgcctgccttaggtcaagtgtgggtgcaggcatgcttttaatccacc

SEQ ID NO: 452177 - DNA, 254 bp, Homo sapiens
cagatgggttgggtgctggaaaggacatgtgtggggtgaggccatggggcagattcggttggcaaggatggaaaaggtgctgccaaagacaggcatagaagaggtggcccaggaggattgtgccgggaggcagaactcaaggactggtccttggatcagagaagaccagctctggtctggggaggaatgggaggaggcttgagcccagctcctgcttcccccaccttgctcggcattgggctgggaagggggcc

SEQ ID NO: 452178 - DNA, 1747 bp, Homo sapiens
  misc_feature (11)..(11): n is a, c, g, or t
  misc_feature (1668)..(1668): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctccaaaaaaaaaataaaaaaaaaattcactggccggtggtttacaacgtgngactggggaaacccctgggtccccaacttatcggcttgcagacatccccttttgccagttgggaatatacgaaaggcct

SEQ ID NO: 452179 - DNA, 1621 bp, Homo sapiens
  misc_feature (11)..(11): n is a, c, g, or t
tcggcctaagngatcagagctgtcagccacggcagggttggctgaagctccactgtttttctttttcctttttttttgagatggagtctcactctgttgcccaggctggagtgcagtggtgtgatatctgctcactgcaaactttgcctcccaggttcaagcgattctcctgcctcagcctcctgagttgctgggattacaggtgtggcgtgagccaccatgcctggccttaccaattatttaactttccttgaaggccctacgctctctagtcagtacgcctttgcacatgctgttcctctgcctagaacaccgtcttgtcctcacttctatccccttcatcctgcatgtccttcaggtctcagcttagatctgaagcaagcttcttggggaagggttctttggacgccccctctctccatgggttagttaccatggatgtgtgcttccatatacttttcacattctaaccattaacacacagctttgtagtcgcctgttcccttgactttccacctcactaggcagtatcatcattaacttttgcattcctttaactgaacaaacgtgtgttacttgttaactatgtgtcatagttacacacatacatacacgataaagacccagaccctgcccttgagatgagtaactgcgtctcttctctggggtctcggcgtctaacagcgtcaggtccaaagcgcttgttgaacgaatgaaccaaggaacgagtgaatgaacgaatgaatgcccgcgaaggacgtggtgccgcgcggtcttctgggaatcgtagtcccctggttcgggcctgtctttacggcgcaggcgtattcacatggaggccgtgttgctgttaatgcgcatgtcccggaatgcggctgggaggactgcgcatgctcgaagggtgggggttgaggccgacggggcgccgtacggcggaggcggggtttcagtggcttctggtgctctagggtgagctctgcccggctgcagggatggcggggaggggtaagctcatcgcagtgatcggagacgaggacacggtgactggtttcctgctgggcggcataggggagcttaacaagaaccgccatcccaatttcctggtggtggagaaggatacaaccatcaatgagatcgaagacactttccggcaatttctaaaccgggatgacattggcatcatcctcatcaaccagtacatcgcagagatggtgcggcatgccctggacgcccaccagcagtccatccccgctgtcctggagatcccctccaaggagcacccatatgacgccgccaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctccactacctcttccctgtgctgttacacagtgtcattgttgatgttaaattaaagtcatattcttgcttctctcca

SEQ ID NO: 452180 - DNA, 1404 bp, Homo sapiens
gcacagatggtttctaagatccctcccaggcctggaacttctaagcgattaggtcaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagaga

SEQ ID NO: 452181 - DNA, 1429 bp, Homo sapiens
attctagaggcttgagagagtcagtgtgcagcggtttcactctgatttgcttctccagtgaagatggttggtagctcctgaggccgggggtcaggaacatggaggcggtgctggggacggtttgttttctaaccacactccttttgtaaccacaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggcggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagaga

SEQ ID NO: 452182 - DNA, 1540 bp, Homo sapiens
gaaagaaagaaaaaaaaacaaaagaaagaaagggggtgtatggtaagtatagcccggtggttataggaagcgtgggtggtagcgcatccggtatatccgggatagctgtgagccaggctgtcggtatacagcagtgaggtcgagtgaggctgaaataggcgtatggtgatcgctgggcttattcgcgccaatactgaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagaga

SEQ ID NO: 452183 - DNA, 1872 bp, Homo sapiens
  misc_feature (315)..(315): n is a, c, g, or t
ggcgaacagccactgcagccgcgcctgcggccgggaagcgagcattttcgcgccctgcacacccagcagccgcaggaggcggcccgaggcgcgccgcgggggagccgggggcggggcgacagtgggaggcgacgcagccgagcgccggcgcccgggggtggagcctccgcccgctcccaggctcccaggctgcggggcccgccctcgggcgccaccgcctccgcccgcgccgcagcaaaatgagccgggccgcgcgccccagaccgccgcgcgctcggccgcccccactgccgagaggcccgcagtcgggccggntggcgcacgagccgggcgggcgaccgcgggaggcgtccgcgtcatctcgcgtcacctcgccccgcccgcttcccaggcttcgagtcccgccctgcgcgcaggcgcaccggcgctgctcggatcctcccttttcggagatttgaatttcccccagcgaggcgagtgaggcgaaatacccgtatggtgatagctggccttttcgcgccaatactgaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagaga

SEQ ID NO: 452184 - DNA, 1475 bp, Homo sapiens
  misc_feature (315)..(315): n is a, c, g, or t
ggcgaacagccactgcagccgcgcctgcggccgggaagcgagcattttcgcgccctgcacacccagcagccgcaggaggcggcccgaggcgcgccgcgggggagccgggggcggggcgacagtgggaggcgacgcagccgagcgccggcgcccgggggtggagcctccgcccgctcccaggctcccaggctgcggggcccgccctcgggcgccaccgcctccgcccgcgccgcagcaaaatgagccgggccgcgcgccccagaccgccgcgcgctcggccgcccccactgccgagaggcccgcagtcgggccggntggcgcacgagccgggcgggcgaccgcgggaggcgtccgcgtcatctcgcgtcacctcgccccgcccgcttcccaggcttcgagtcccgccctgcgcgcaggcgcaccggcgctgctcggatcctcccttttcggagatttgaatttcccccagcgaggcgagtgaggcgaaatacccgtatggtgatagctggccttttcgcgccaatactgaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaatgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagaga

SEQ ID NO: 452185 - DNA, 1502 bp, Homo sapiens
attctagaggcttgagagagtcagtgtgcagcggtttcactctgatttgcttctccagtgaagatggttggtagctcctgaggccgggggtcaggaacatggaggcggtgctggggacggtttgttttctaaccacactccttttgtaaccacaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagaga

SEQ ID NO: 452186 - DNA, 4094 bp, Homo sapiens
  misc_feature (3835)..(3835): n is a, c, g, or t
  misc_feature (3974)..(3974): n is a, c, g, or t
  misc_feature (4050)..(4050): n is a, c, g, or t
cctctatttcttcctttttcctttcttctgtctaaaaactctctcttgttccccttttccagcttcccttggactactgccccaatggccccttggactcgcgtttcatgtatgcgagcacacacacacacaaacttgcaaaataccgtttttcttaaggattgtgggaccgaataatatcacgtgccttcatcttttccttttatagttagatgaacctcttcctctttacaatttttttaaaaagtgataggggaggttgatgtgttagtggaagatttgggcatcgtttgagaagtaacttttgtttaacacattccccctaaacattgaacacaaacatttcaaccccttcatgacactctttggacatttaaagcattgagtaaccatgtacatgacagcctaaatccgtttgatttcagagcatttcctgaacattgtatttcatagacttctctgattttttcaaaaatgaggtgagcaatggcaagcagccttgttctcccaatttggtgcttttgcttttggtgtggggtgggcatggggggttgggggtggtgtgggtgtgtttagaaaaaagatgcattcctgaagatctctggtgctgaagggcctcgagttcctttcagagactgtatttgacacactttaggtacacacaaacgaatggtatcacatgcaatattttaatggagcaatgggagaggctctttgaaatggggtttgcatctttttgtaacattttgatttctctggtgccttattcctacttgatgctggcactcacatacccacaagaagctgacacagaagtcagccttaggcgtggggacatatgggtgatgtttgagcatgcaggggccatggggagtttggtgtcagttggtggagaagggactagatggcatctcttagccgaggccaacaggaactgcacaagtccattatagtcaaagttagcaattttgatacgtaaacacaatacttcattcttcctcatctgagctttccttccttcttccttttctatctctaccttctcataaaggtgctgctgctgctgctaaggtgcccggagtccagaatgtccattaatcactcaggcacgagcctggcactgccacgtcagcccccagcatgaccaaacccaggtttctcttgcttggggctgagaactgtcagatttttctcatcaaaaatgttttccaaggaatcagtggattacagtttttctgcattgaaaatgcactttaaaaaataaattaaagctccagactgtttaaaatatacagagggagcaggggaaagttaagcatgtgctagtgtctgaacccagttcagtttatctccagttgaaacgatatacactatattatgtataaatgtatacacacttcctatatgtatccacatatatatagtgtatatattatacatgtataggtgtgtatatgtgcatatatacacacatgcacataacaaaatcagatgctcattacaaatccagatgctcattacaaaaccagatgctacacaaacagcagcagaggaaacaaggttggactcttgcaacagatcacaaaaaataaaaacagctacttgcagtgactttggtcatttctgtatgttcataaagaatggattgtaacaaggaaaaaaaggaacagtgttagtgaaaaaggaaaaatgggcgaaaccatcttgatccgatgcgaatgcagtaatgttctatataccatttcatcagttatttcttttagtcatgttgatttgatttcagtttctggctatgaaaaacatttttaaactcgtcacccacaacaaactgaacaaaactactacagtgaaagcccttttcagtgaaagatgtcagaaacctcaaaacctttggcctgactcagaactaccatgtgaaaatcagtactctcttaatgtttgaaataaaaactgaaaaaaaaaacaaaaaaacaaaaaaccttttttgaagcaccttaacgtggccatccatttgagaagtgggtgccacttttttctttgagcaccttattgatgtgtttgctatctgctgtctttctgttacctgttggctgaatggctagctgttaacatatacatgtgcacagaagagatatctgggcatgtatgttctcaatgaagtttactgtggtgactgctgaaaggtgaacccatttcctgatttttcccgccgcagtgttgtgataagattcgaagaaacctttttccctgcacagaaatgtttcttatcacattgtatcttagtatggaaaggaatatggtcccttttttgcaattgctactgtgtacacacacacacacacacacacacacacacacacacacacactctgtatgtttagacctaaaatacacacacccacgcacacactgtatgtttatgtgacctaaaacatacacacatgcacacacacatacatatccattcattcattcattcaagtggtgtttccagtgtctgtgtgtcactgtttatgcagtttccatttcccagtgaattatgagtggagggcaacttttctaaccagattgtcttttcagaacaaagacctgggaattgaggaagagtttggaaagagggagaggcaaggaaagagagctttaaattgaaaggttaatttcctaagaggaacctgggctgaatgactacagtgttataccctccaatctttgcaggtgggcatggaacactgcttgtatcactctgtgcacggtataaatccatatatccacaaaaacacacatccatccatcaacatatacatggtttgggatgagcaggtcaatagttttgagagggagtttgttcctttttttttctcattatactcttaaattgttgtcagttatcaaacaaacaaacagaaaaattgtttggaaaaaccttgcatacgccttttctatcaagtgctttaaaatatagactaaatacacacatcctgccagttttttcttacagtgacagtatccttacctgccatttaatattagcctcgtatttttctcacgtatatttacctgtgacttgtatttgttatttaaacaggaaaaaaaacattcaaaaaaagaaaaattaactgtagcgcttcattatactattatattattattattattgtgacattttggaatactgtgaagttttatctcttgcatatactttatacggaagtattacgccttaaaaatacgaaaataaattttacaaggtttctgttttgtgtggaagagtaattgatgttgctaagaatgatgtttgtttttttggggtttttgttgttttttttttaaatgttaccagcactttttttgtaagtttcactttccgaggtattgtacaagttcacactgtttgtgaagtttgaatatgaaggaataattaaaaaaaaaactcttaaaaaaaaaaaataattacagagggggaatataataaaaaacctataacaaaaggaaaatgactaataatctcaactataacaactgcctacataggttattaccttccgggtagtcccttaacattctgaggggccacatggatgacaaacttactatccgccatgcccttcgttgacacagacctatgccaatgattttgaggatgctactaagcatacaaataaacattgtggatggcatcatagccaaagttagtctttccttgcccaacgattgagccaaagcgattttagaatcgagaaggtttatccatgatgtcgatataacagctcattaatccaattcctcctattgcaacatatatccaatttgccgttgccctggtttacacttactntaccttgaaaacctcggcgtttcccaacataataggcttggataaaacccttattttcccactcaaaattatagggaaaagcccaaaccggctagctttcctaacaaagggggcagcctaataggcaatagaactttgnagccgtattattctttgtgaaattgggcctaaatctatcttaaactagctcttttttttacccctaacttggaatnggcaagggacttgtggatcaaaagactaaccgggagggggttaa

SEQ ID NO: 452187 - DNA, 4040 bp, Homo sapiens
  misc_feature (3781)..(3781): n is a, c, g, or t
  misc_feature (3920)..(3920): n is a, c, g, or t
  misc_feature (3996)..(3996): n is a, c, g, or t
cctctatttcttcctttttcctttcttctgtctaaaaactctctcttgttccccttttccagcttcccttggactactgccccaatggccccttggactcgcgtttcatgtatgcgagcacacacacacacaaacttgcaaaataccgtttttcttaaggattgtgggaccgaataatatcacgtgccttcatcttttccttttatagttagatgaacctcttcctctttacaatttttttaaaaagtgataggggaggttgatgtgttagtggaagatttgggcatcgtttgagaagtaacttttgtttaacacattccccctaaacattgaacacaaacatttcaaccccttcatgacactctttggacatttaaagcattgagtaaccatgtacatgacagcctaaatccgtttgatttcagagcatttcctgaacattgtatttcatagacttctctgattttttcaaaaatgaggtgagcaatggcaagcagccttgttctcccaatttggtgcttttgcttttggtgtggggtgggcatggggggttgggggtggtgtgggtgtgtttagaaaaaagatgcattcctgaagatctctggtgctgaagggcctcgagttcctttcagagactgtatttgacacactttaggtacacacaaacgaatggtatcacatgcaatattttaatggagcaatgggagaggctctttgaaatggggtttgcatctttttgtaacattttgatttctctggtgccttattcctacttgatgctggcactcacatacccacaagaagctgacacagaagtcagccttaggcgtggggacatatgggtgatgtttgagcatgcaggggccatggggagtttggtgtcagttggtggagaagggactagatggcatctcttagccgaggccaacaggaactgcacaagtccattatagtcaaagttagcaattttgatacgtaaacacaatacttcattcttcctcatctgagctttccttccttcttccttttctatctctaccttctcataaaggtgctgctgctgctgctaaggtgcccggagtccagaatgtccattaatcactcaggcacgagcctggcactgccacgtcagcccccagcatgaccaaacccaggtttctcttgcttggggctgagaactgtcagatttttctcatcaaaaatgttttccaaggaatcagtggattacagtttttctgcattgaaaatgcactttaaaaaataaattaaagctccagactgttagttcagtttatctccagttgaaacgatatacactatattatgtataaatgtatacacacttcctatatgtatccacatatatatagtgtatatattatacatgtataggtgtgtatatgtgcatatatacacacatgcacataacaaaatcagatgctcattacaaatccagatgctcattacaaaaccagatgctacacaaacagcagcagaggaaacaaggttggactcttgcaacagatcacaaaaaataaaaacagctacttgcagtgactttggtcatttctgtatgttcataaagaatggattgtaacaaggaaaaaaaggaacagtgttagtgaaaaaggaaaaatgggcgaaaccatcttgatccgatgcgaatgcagtaatgttctatataccatttcatcagttatttcttttagtcatgttgatttgatttcagtttctggctatgaaaaacatttttaaactcgtcacccacaacaaactgaacaaaactactacagtgaaagcccttttcagtgaaagatgtcagaaacctcaaaacctttggcctgactcagaactaccatgtgaaaatcagtactctcttaatgtttgaaataaaaactgaaaaaaaaaacaaaaaaacaaaaaaccttttttgaagcaccttaacgtggccatccatttgagaagtgggtgccacttttttctttgagcaccttattgatgtgtttgctatctgctgtctttctgttacctgttggctgaatggctagctgttaacatatacatgtgcacagaagagatatctgggcatgtatgttctcaatgaagtttactgtggtgactgctgaaaggtgaacccatttcctgatttttcccgccgcagtgttgtgataagattcgaagaaacctttttccctgcacagaaatgtttcttatcacattgtatcttagtatggaaaggaatatggtcccttttttgcaattgctactgtgtacacacacacacacacacacacacacacacacacacacacactctgtatgtttagacctaaaatacacacacccacgcacacactgtatgtttatgtgacctaaaacatacacacatgcacacacacatacatatccattcattcattcattcaagtggtgtttccagtgtctgtgtgtcactgtttatgcagtttccatttcccagtgaattatgagtggagggcaacttttctaaccagattgtcttttcagaacaaagacctgggaattgaggaagagtttggaaagagggagaggcaaggaaagagagctttaaattgaaaggttaatttcctaagaggaacctgggctgaatgactacagtgttataccctccaatctttgcaggtgggcatggaacactgcttgtatcactctgtgcacggtataaatccatatatccacaaaaacacacatccatccatcaacatatacatggtttgggatgagcaggtcaatagttttgagagggagtttgttcctttttttttctcattatactcttaaattgttgtcagttatcaaacaaacaaacagaaaaattgtttggaaaaaccttgcatacgccttttctatcaagtgctttaaaatatagactaaatacacacatcctgccagttttttcttacagtgacagtatccttacctgccatttaatattagcctcgtatttttctcacgtatatttacctgtgacttgtatttgttatttaaacaggaaaaaaaacattcaaaaaaagaaaaattaactgtagcgcttcattatactattatattattattattattgtgacattttggaatactgtgaagttttatctcttgcatatactttatacggaagtattacgccttaaaaatacgaaaataaattttacaaggtttctgttttgtgtggaagagtaattgatgttgctaagaatgatgtttgtttttttggggtttttgttgttttttttttaaatgttaccagcactttttttgtaagtttcactttccgaggtattgtacaagttcacactgtttgtgaagtttgaatatgaaggaataattaaaaaaaaaactcttaaaaaaaaaaaataattacagagggggaatataataaaaaacctataacaaaaggaaaatgactaataatctcaactataacaactgcctacataggttattaccttccgggtagtcccttaacattctgaggggccacatggatgacaaacttactatccgccatgcccttcgttgacacagacctatgccaatgattttgaggatgctactaagcatacaaataaacattgtggatggcatcatagccaaagttagtctttccttgcccaacgattgagccaaagcgattttagaatcgagaaggtttatccatgatgtcgatataacagctcattaatccaattcctcctattgcaacatatatccaatttgccgttgccctggtttacacttactntaccttgaaaacctcggcgtttcccaacataataggcttggataaaacccttattttcccactcaaaattatagggaaaagcccaaaccggctagctttcctaacaaagggggcagcctaataggcaatagaactttgnagccgtattattctttgtgaaattgggcctaaatctatcttaaactagctcttttttttacccctaacttggaatnggcaagggacttgtggatcaaaagactaaccgggagggggttaa

SEQ ID NO: 452188 - DNA, 4040 bp, Homo sapiens
  misc_feature (3781)..(3781): n is a, c, g, or t
  misc_feature (3920)..(3920): n is a, c, g, or t
  misc_feature (3996)..(3996): n is a, c, g, or t
cctctatttcttcctttttcctttcttctgtctaaaaactctctcttgttccccttttccagcttcccttggactactgccccaatggccccttggactcgcgtttcatgtatgcgagcacacacacacacaaacttgcaaaataccgtttttcttaaggattgtgggaccgaataatatcacgtgccttcatcttttccttttatagttagatgaacctcttcctctttacaatttttttaaaaagtgataggggaggttgatgtgttagtggaagatttgggcatcgtttgagaagtaacttttgtttaacacattccccctaaacattgaacacaaacatttcaaccccttcatgacactctttggacatttaaagcattgagtaaccatgtacatgacagcctaaatccgtttgatttcagagcatttcctgaacattgtatttcatagacttctctgattttttcaaaaatgaggtgagcaatggcaagcagccttgttctcccaatttggtgcttttgcttttggtgtggggtgggcatggggggttgggggtggtgtgggtgtgtttagaaaaaagatgcattcctgaagatctctggtgctgaagggcctcgagttcctttcagagactgtatttgacacactttaggtacacacaaacgaatggtatcacatgcaatattttaatggagcaatgggagaggctctttgaaatggggtttgcatctttttgtaacattttgatttctctggtgccttattcctacttgatgctggcactcacatacccacaagaagctgacacagaagtcagccttaggcgtggggacatatgggtgatgtttgagcatgcaggggccatggggagtttggtgtcagttggtggagaagggactagatggcatctcttagccgaggccaacaggaactgcacaagtccattatagtcaaagttagcaattttgatacgtaaacacaatacttcattcttcctcatctgagctttccttccttcttccttttctatctctaccttctcataaaggtgctgctgctgctgctaaggtgcccggagtccagaatgtccattaatcactcaggcacgagcctggcactgccacgtcagcccccagcatgaccaaacccaggtttctcttgcttggggctgagaactgtcagatttttctcatcaaaaatgttttccaaggaatcagtggattacagtttttctgcattgaaaatgcactttaaaaaataaattaaagctccagactgtttaaaatatacagagggagcaggggaaagttaagcatgtgctagtgtctgaacccagttcagtttatctccagttgaaacgatatacactatattatgtataaatgtatacacacttcctatatgtatccacatatatatagtgtatatattatacatgtataggtgtgtatatgtgcatatatacacacatgcacataacaaaatcagatgctcattacaaatccagatgctcattacaaaaccagatgctacacaaacagcagcagaggaaacaaggttggactcttgcaacagatcacaaaaaataaaaacagctacttgcagtgactttggtcatttctgtatgttcataaagaatggattgtaacaaggaaaaaaaggaacagtgttagtgaaaaaggaaaaatgggcgaaaccatcttgatccgatgcgaatgcagtaatgttctatataccatttcatcagttatttcttttagtcatgttgatttgatttcagtttctggctatgaaaaacatttttaaactcgtcacccacaacaaactgaacaaaactactacagtgaaagcccttttcagtgaaagatgtcagaaacctcaaaacctttggcctgactcagaactaccatgtgaaaatcagtactctcttaatgtttgaaataaaaactgaaaaaaaaaacaaaaaaacaaaaaaccttttttgaagcaccttaacgtggccatccatttgagaagtgggtgccacttttttctttgagcaccttattgatgtgtttgctatctgctgtctttctgttacctgttggctgaatggctagctgttaacatatacatgtgcacagaagagatatctgggcatgtatgttctcaatgaagtttactgtggtgactgctgaaaggtgaacccatttcctgatttttcccgccgcagtgttgtgataagattcgaagaaacctttttccctgcacagaaatgtttcttatcacattgtatcttagtatggaaaggaatatggtcccttttttgcaattgctactgtgtacacacacacacacacacacacacacacacacacacacacactctgtatgtttagacctaaaatacacacacccacgcacacactgtatgtttatgtgacctaaaacatacacacatgcacacacacatacatatccattcattcattcattcaagtggtgtttccagtgtctgtgtgtcactgtttatgcagtttccatttcccagtgaattatgagtggagggcaacttttctaaccagattgtcttttcagaacaaagacctgggaattgaggaagagtttggaaagagggagaggcaaggaaagagagctttaaattgaaaggttaatttcctaagaggaacctgggctgaatgactacagtgttataccctccaatctttgcaggtgggcatggaacactgcttgtatcactctgtgcacggtataaatccatatatccacaaaaacacacatccatccatcaacatatacatggtttgggatgagcaggtcaatagttttgagagggagtttgttcctttttttttctcattatactcttaaattgttgtcagttatcaaacaaacaaacagaaaaattgtttggaaaaaccttgcatacgccttttctatcaagtgctttaaaatatagactaaatacacacatcctgccagttttttcttacagtgacagtatccttacctgccatttaatattagcctcgtatttttctcacgtatatttacctgtgacttgtatttgttatttaaacaggaaaaaaaacattcaaaaaaagaaaaattaactgtagcgcttcattatactattatattattattattattgtgacattttggaatactgtgaagttttatctcttgcatatactttatacggaagtattacgccttaaaaatacgaaaatgatgtttgtttttttggggtttttgttgttttttttttaaatgttaccagcactttttttgtaagtttcactttccgaggtattgtacaagttcacactgtttgtgaagtttgaatatgaaggaataattaaaaaaaaaactcttaaaaaaaaaaaataattacagagggggaatataataaaaaacctataacaaaaggaaaatgactaataatctcaactataacaactgcctacataggttattaccttccgggtagtcccttaacattctgaggggccacatggatgacaaacttactatccgccatgcccttcgttgacacagacctatgccaatgattttgaggatgctactaagcatacaaataaacattgtggatggcatcatagccaaagttagtctttccttgcccaacgattgagccaaagcgattttagaatcgagaaggtttatccatgatgtcgatataacagctcattaatccaattcctcctattgcaacatatatccaatttgccgttgccctggtttacacttactntaccttgaaaacctcggcgtttcccaacataataggcttggataaaacccttattttcccactcaaaattatagggaaaagcccaaaccggctagctttcctaacaaagggggcagcctaataggcaatagaactttgnagccgtattattctttgtgaaattgggcctaaatctatcttaaactagctcttttttttacccctaacttggaatnggcaagggacttgtggatcaaaagactaaccgggagggggttaa

SEQ ID NO: 452189 - DNA, 1450 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccaga

SEQ ID NO: 452190 - DNA, 511 bp, Homo sapiens
gtagaaagaagattttctttattttagactttccatttcaacacggttgaagaggttcattcaagattccagagtctgaatgctgatatcaacaaacgtggagcgtcttatattctgaaacttgctaatagattatatggagagaaaacttacaatttccttcctgtaagtactttgcccttcacattctaaaaccccactagacagtgcagatattttccagcacaatcaagtcatggaggtcagttttaatatttgtaaactttcagaaaaacaatacagaaggcaaacatggcaaaaacaatatggaaggcaaacacgacagaatgcaaactttaattgacatggtgattttgtgttacagtctttttagtgaaaagatagctcttggaggttttactgaagcaagagtacaatcagtgtttgtgaaatcttagtcaaagttcagaaaagagtggtaatttctatataacaacaacagtataagggttaggcttaccactactggaat

SEQ ID NO: 452191 - DNA, 469 bp, Homo sapiens
gcgaattcactagtgattgagtacctggttctcgtgtggaataaaaaagcggggagaaagtacaagatccaggatgcctcagggcggttggcagaaattgaggaagcttctggagaaatagtgctgcctaatctgctggcgtgggcagtgggcaccatgaggaccctgttctgtgttgcagttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaaggtcagcagaaacaaaaaaaagggtctgctttcctcccatctccctacgaatggacagtctgcatggaaaggttgtgcctttgagctcttaccttgtgttttcagaactgtat

SEQ ID NO: 452192 - DNA, 502 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcgggtaaggccgggcctcggagcggtggcgcgggggcgggcgcggggagaggccaggctccctcgctcagcttccagcccggcaccccccaccccccaggctcaggcccctcagacccgcagctccctgcgctcgccctccccgccagcttcgcgcccccatcccttccgggcgccccgacggagacagacgacctctgatcccccgcccccgcctgggtacaggccgggccagcccgcgagggagggagggagggaggacgacagatgcaggcggaaggcaagactgaaacctgagatcagaatgttgt

SEQ ID NO: 452193 - DNA, 2052 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctgcattcccttgtttgttcttctttatgtataatatatagttcatgtggcgctgcatgaaatcaagaagtgggtgtcttaggataaaagataccaagagtctacaaaaataaccatgtagtaagataa

SEQ ID NO: 452194 - DNA, 1996 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggttacgaagacaagcttgcctcgcctgacttttctgtcccttgttctgcaggattagtattctgttacagacctctagtttttagactcttcaattaaagggccaatggttataacctgcattcccttgtttgttcttctttatgtataatatatagttcatgtggcgctgcatgaaatcaagaagtgggtgtcttaggataaaagataccaagagtctacaaaaataaccatgtagtaagataa

SEQ ID NO: 452195 - DNA, 2807 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggagctgtttgtgacggtttccaggcagcccagggccaggccgcggctcctatctgcagctgcagggagagagaggaggaaccccgtgcgattctagagacgatttcacaacaaggagaaatcagctttgtgcttacatgccgagcagccagcacagttcttctttgcctgtcctcgggggaaatcagggctctgagagtggagatcgagatgggctagtgggtggcggatgggacgctgcacggccagaccctggactgtggtgggtttccaaactggcacatcctacaccggctctgagactgtgggcactggacctcataccttttgaacctcaaaaataaggaagaattatattattataataattacagtgatacctttgctggagttttaatgcatagtaggtagctgagtctctgatagaaggctcttagttcaggtgaaggtaggcaatggattcattgcccaatgaatcagagacttgaatcaaaggctcagaagcacgtgcgctcccacacataggttgggaagacccagggctgggtgggccctcccaccccactaaagctggggtagctggggcctgccttacccccgccccacccccagactcacctgtctgcaaggtcagagccctttagggcaccctgggtgccctaaaatcccctataactgctgagtccttggccagagtggtcccacatttgtgggcctgggaaagtgttcttgccctgctggaataaaaaagcggggagaaagtacaagatccaggatgcctcagggcggttggcagaaattgaggaagcttctggagaaatagtgctgcctaatctgctggcgtgggcagtgggcaccatgaggaccctgttctgtgttgcagttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452196 - DNA, 2298 bp, Homo sapiens
cgtcatagccgtttcctgaggataaacagcgggcagtgtaccacgctaataattacagtgatacctttgctggagttttaatgcatagtaggtagctgagtctctgatagaaggctcttagttcaggtgaaggtaggcaatggattcattgcccaatgaatcagagacttgaatcaaaggctcagaagcacgtgcgctcccacacataggttgggaagacccagggctgggtgggccctcccaccccactaaagctggggtagctggggcctgccttacccccgccccacccccagactcacctgtctgcaaggtcagagccctttagggcaccctgggtgccctaaaatcccctataactgctgagtccttggccagagtggtcccacatttgtgggcctgggaaagtgttcttgccctgctggaataaaaaagcggggagaaagtacaagatccaggatgcctcagggcggttggcagaaattgaggaagcttctggagaaatagtgctgcctaatctgctggcgtgggcagtgggcaccatgaggaccctgttctgtgttgcagttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452197 - DNA, 1817 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452198 - DNA, 1996 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaaggtcagcagaaacaaaaaaaagggtctgctttcctcccatctccctacgaatggacagtctgcatggaaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452199 - DNA, 1342 bp, Homo sapiens
  misc_feature (24)..(24): n is a, c, g, or t
aattcgcggccgcgtcgacacggntgcgagaagacgacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452200 - DNA, 1445 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452201 - DNA, 826 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagtctgatttgattactaatgacagacaggactctaagggccccttcctcctgcaact

SEQ ID NO: 452202 - DNA, 659 bp, Homo sapiens
tctgctcagaggatactagagcgtggataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452203 - DNA, 1302 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggagctgtttgtgacggtttccaggcagcccagggccaggccgcggctcctatctgcagctgcagggagagagaggaggaaccccgtgcgattctagagacgatttcacaacaaggagaaatcagctttgtgcttacatgccgagcagccagcacagttcttctttgcctgtcctcgggggaaatcagggctctgagagtggagatcgagatgggctagtgggtggcggatgggacgctgcacggccagaccctggactgtggtgggtttccaaactggcacatcctacaccggctctgagactgtgggcactggacctcataccttttgaacctcaaaaataaggaagaattatattattataataattacagtgatacctttgctggagttttaatgcatagtaggtagctgagtctctgatagaaggctcttagttcaggtgaaggtaggcaatggattcattgcccaatgaatcagagacttgaatcaaaggctcagaagcacgtgcgctcccacacataggttgggaagacccagggctgggtgggccctcccaccccactaaagctggggtagctggggcctgccttacccccgccccacccccagactcacctgtctgcaaggtcagagccctttagggcaccctgggtgccctaaaatcccctataactgctgagtccttggccagagtggtcccacatttgtgggcctgggaaagtgttcttgccctgctggaataaaaaagcggggagaaagtacaagatccaggatgcctcagggcggttggcagaaattgaggaagcttctggagaaatagtgctgcctaatctgctggcgtgggcagtgggcaccatgaggaccctgttctgtgttgcagttttcaccatggagcagctgagctcagcaaacacccgcttcgccttggacctgttcctggcgttgagtgagaacaatccggcttccatccgcaccacacctcacacacacagtgtaaaaaatgccatcagccttttatccttcatactcagattagatcttgccatttctttctgttcccatacaggctttcttcctttactgctcgtcgagtcaacgcagctggg

SEQ ID NO: 452204 - DNA, 463 bp, Homo sapiens
gctactactactaaattcccccccgtcgacgcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccaga

SEQ ID NO: 452205 - DNA, 1926 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452206 - DNA, 2228 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctgaaaaaaaaaaaaaaaaaaaaaaaaaaaaattttgttgggccgccctgggcccctggaaaaatttttctatagaccccttcgcgtggggcgcgcgccgggccgcaagtgggctaggcgtgaacctggccccaagactgggtccctaaagaaaacccggccccaggaaaagctgcggggattctcccccccaaataaaagagcccgcgggggaaaccggagcgcttcggaaccactccgagatgtcccgcggaaggcccatgaagggctctacaacacgggtgtccaggggaccgaattaatac

SEQ ID NO: 452207 - DNA, 2186 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggagctgtttgtgacggtttccaggcagcccagggccaggccgcggctcctatctgcagctgcagggagagagaggaggaaccccgtgcgattctagagacgatttcacaacaaggagaaatcagctttgtgcttacatgccgagcagccagcacagttcttctttgcctgtcctcgggggaaatcagggctctgagagtggagatcgagatgggctagtgggtggcggatgggacgctgcacggccagaccctggactgtgttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452208 - DNA, 1817 bp, Homo sapiens
ccccccccccccccacctacgcagtacagcccggggtactcggccgaggcagctcggagccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452209 - DNA, 1900 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452210 - DNA, 1872 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaattaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452211 - DNA, 1333 bp, Homo sapiens
cgctcacttctgcttgcacttaggcgacctcgggagctcggactcctacgcagtcaccgggaagggccgccgccccgcccgcggctgctggcccgggtgacacttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaattgtgatgtgctccagtcgtcatggtgaacttaagtgctatagaaaacctcacccaaagcaacagaaagtagaaatgctgaataaaaccaaaccagacaataaatatacataagaaatacccaaaggatgagaagaaattcctcaggtaccagaaacagggcagaactcaaagccactgttgtaaagtctgagtaacaaatgtggcctcaaagcatgaagaggtgcttaaaacaggagctccctgatgaggccaaagcactacctatccaaaaaagaaagtgaaaattcacagttcccacaagcaatatataaaagtaacctttccccatcactgccaacagtagttgtatccagttaattttatcccaataaagtagatgagaaaggatcttgtactaactctacaaatttgcatttacttcagtatcatttttatgtcttttattgattggataaacactgccattgaattaacttcatttattttacccatattacgatttgcttactatccttgaat

SEQ ID NO: 452212 - DNA, 852 bp, Homo sapiens
gactagttctagctcgcgatctagaactagtggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgtccagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctg

SEQ ID NO: 452213 - DNA, 732 bp, Homo sapiens
atatttccttttccttttttttaataggagttcttggtttcgactcagaaaacatatggtgctgacctggccagtgtggattttcagcatgcctctgaagatgcaaggaagaccataaaccagtgggtcaaaggacagacagaaggtgagagcctgggcagaatggaatcattatgcgctggtcatgtcattcgtttcctcagtccgccttccctacctgcagttattccctccccagctcccacagtcctggcgcacatcgtggttacagtcagaggacgctgccggtgcgtgaagtctgcactgcacgttgctggacagctctcacatgttcgaagttcaccagagtggaaacttaaacatgatttaactcaagcagctaaatccttttttctcatcagctccccaaaacttttaaagttgcatttcaaagttaaaaccaacattggcaggcgcggtggctcatgcctgtaatcccagcactttgggagcccaaggcgggcggatcatttgaggtcaggagttcaagaccagcttggccaacatgatgaaaccctgtctctactaaaaatacaaaaaatttagccaggtgtggtagcacacacctgtaatcccagctactctggaggctgaggcaggagaatctctcgaacacaggaggtaaaggttacagtgagccgagatcatgccactgtactccagcctaggcaacagagcgagactccgtcgtaa

SEQ ID NO: 452214 - DNA, 653 bp, Homo sapiens
ataggcttaacaaacatacatgatgattacttggtgtttttctccctacagtccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgtaaggtttggggttatttaatttttttccttgtaatcttactgaattctgggaatgtcattgttctgtaaggtcattgttgagactgggttgtgtcacatatgttgaggtggggttgtgtcagtattttttgtcccacgtcccagaacacgatgaaactaccttatggggagtttgttaataggttgggaaataagcctcttcagatgacatctaatatagaagaatccttttctcaaattctgatgtagagtaaaagaaatttaccaagttttgggctgctagcttttagtagatgtcatcctacagattttctttgggcatcaacttcagaaacaatgaaggagcactttaatatttgaccacatcctctaagagattcagtataacagttgtaaatgaatagttaatactgaataacaatacatactgagtgtcc

SEQ ID NO: 452215 - DNA, 383 bp, Homo sapiens
tctagcaggatccctgcacacgcgaataccacacagagtatgtgtcaggtaggaaccaaatttatgattgttatattcaaactggttttctgttccttgaaaatggtgttttttctgatcaaagcctatttaggagttattatgttcttgagtttattccatgtgtgtgaatattttgaatgaatccactaataagatatgcatgtatgtctggagcgctagcaatgtagaataaatatttaagtagactttaacaagtaaatggttgtaggcatcattaagtcttaaatagccttttcaaagatattagtgttcttgttttaattattcagataattcctttaattctccactcaaatctgactttatagatagattgtctg

SEQ ID NO: 452216 - DNA, 2315 bp, Homo sapiens
acagagcctgtagacctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgtaaggtttggggttatttaatttttttccttgtaatcttactgaattctgggaatgtcattgttctgtaaggtcattgttgagactgggttgtgtcacatatgttgaggtggggttgtgtcagtattttttgtcccacgtcccagaacacgatgaaactaccttatggggagtttgttaataggttgggaaataagcctcttcagatgacatctaatatagaagaatccttttctcaaattctgatgtagagtaaaagaaatttaccaagttttgggctgctagcttttagtagatgtcatcctacagattttctttgggcatcaacttcagaaacaatgaaggagcactttaatatttgaccacatcctctaagagattcagtataacagttgtaaatgaatagttaatactgaataacaatacatactgagtgtcc

SEQ ID NO: 452217 - DNA, 2880 bp, Homo sapiens
acagagcctgtagacctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactactttgggattgcctaacaactcgaataattcttcactactggatgacgagagggtgagggtggcggcggcggcatcagtcacagtgctttctggaatcatccagttggcttttgggattctgcggattggatttgtagtgatatacctgtctgagtccctcatcagtggcttcactactgctgctgctgttcatgttttggtttcccaactcaaattcatttttcagttgacagtcccgtcacacactgatccagtttcaattttcaaagtactatactctgtattctcacaaatagagaagactaatattgcagacctggtgacagctctgattgtccttttggttgtatccattgttaaagaaataaatcagcgcttcaaagacaaacttccagtgcccattccaatcgaattcattatgaccgtgattgcagcaggtgtatcctacggctgtgactttaaaaacaggtttaaagtggctgtggttggggacatgaatcctggatttcagccccctattacacctgacgtggagactttccaaaacaccgtaggagattgcttcggcatcgcaatggttgcatttgcagtggccttttcagttgccagcgtctattccctcaaatacgattatccacttgatggcaatcaggagttaatagccttgggactgggtaacatagtctgtggagtattcagaggatttgctgggagtactgccctctccagatcagcagttcaggagagcacaggaggcaaaacacagattgctgggcttattggtgccatcatcgtgctgattgtcgttctagccattggatttctcctggcgcctctacaaaagtccgtcctggcagctttagcattgggaaacttaaagggaatgctgatgcagtttgctgaaataggcagattgtggcgaaaggacaaatatgattgtttaatttggatcatgaccttcatcttcaccattgtcctgggactcgggttaggcctggcagctagtgtggcatttcaactgctaaccatcgtgttcaggacccaatttccaaaatgcagcacgctggctaatattggaagaaccaacatctataagaataaaaaagattattatgatatgtatgagccagaaggagtgaaaattttcagatgtccatctcctatctactttgcaaacattggtttctttaggcggaaacttatcgatgctgttggctttagtccacttcgaattctacgcaagcgcaacaaagctttgaggaaaatccgaaaactgcagaagcaaggcttgctacaagtgacaccaaaaggatttatatgtactgttgacaccataaaagattctgacgaagagctggacaacaatcagatagaagtactggaccagccaatcaataccacagacctgcctttccacattgactggaatgatgatcttcctctcaacattgaggtccccaaaatcagcctccacagcctcattctcgacttttcagcagtgtcctttcttgatgtttcttcagtgaggggccttaaatcgattttgcaagaatttatcaggatcaaggtagatgtgtatatcgttggaactgatgatgacttcattgagaagcttaaccggtatgaattttttgatggtgaagtgaaaagctcaatatttttcttaacaatccatgatgctgttttgcatattttgatgaagaaagattacagtacttcaaagtttaatcccagtcaggaaaaagatggaaaaattgattttaccataaatacaaatggaggattacgtaatcgggtatatgaggtgccagttgaaacaaaattctaatcaacatataattcagaaggatcttcatctgactatgacataaaaacaactttatacccagaaagttattgataagttcatacattgtacgaagagtatttttgacagaatatgtttcaaactttggaacaagatggttctagcatggcatatttttcacatatctagtatgaaattatataagtattctaaattttatatcttgtagctttatcaaagggtgaaaattattttgttcatacatatttttgtagcactgacagatttccatcctagtcactaccttcatgcataggtttagcagtatagtggcgccactgttttgaatctcataatttatacaggtcatattaatatatttccattaaaaaatcagttgtacagtg

SEQ ID NO: 452218 - DNA, 721 bp, Homo sapiens
acagagcctgtagacctgagtggatggacactgcctcttagaactagaacttagaactttatcttgaaaatgtaccactgttgcagaagctcctcacagagtatgtgtcaggcatttttaacctgctaaaggcaagaagaagtgttcaccacatagttgcaaaggtcttcaacttgccacagccaacagaaaaatcaaaatgattgaaccctttgggaatcagtatattgtggccaggccagtgtattctacaaatgcttttgaggaaaatcataaaaagacaggaagacatcataagacatttctggatcatctcaaagtgtgttgtagctgttccccacaaaaggccaagagaattgtcctctctttgttccccatagcatcttggttgccagcataccggcttaaagaatggttgctcagtgatattgtttctggtatcagcacagggattgtggccgtactacaaggtttagcatttgctctgctggtcgacattcccccagtctatgggttgtatgcatcctttttcccagccataatctaccttttcttcggcacttccagacacatatccgtgggtccgtttccgattctgagtatgatggtgggactagcagtttcaggagcagtttcaaaagcagtcccagatcgcaatgcaactcgaaagccccaagcggcaactcgaaagccccaagcggcatctcgaaagccccaagcg

SEQ ID NO: 452219 - DNA, 1121 bp, Homo sapiens
cgtcgcgccgccggctgctgccttcttcctcctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagctt

SEQ ID NO: 452220 - DNA, 376 bp, Homo sapiens
aaagaggatgttgaggcttgttttttcttcggacccaagggtgctcgggagccctccagtctctgcctttctcacacaaggcgtctctgggaaggcagtggattgttggtctgcgtggaacttctcaggtggacaccagagcatggaacgtaaggaatcgcccccacccctttccatgtccgcagtttgcctgtcgccttggccctgggcggggcaggggctgggaagagtgtgctgtgaggacacagaggtgcacaggtgactgtggaagggccagtaggagcacttggctttctgtgagtcccgaaccctcgtgtgaaaacgccacgatgccctttctgagtggagccaaccctctgccaccagctttcctgct

SEQ ID NO: 452221 - DNA, 1108 bp, Homo sapiens
ctcactatagggctcgagcggccgcccgggcagtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagctt

SEQ ID NO: 452222 - DNA, 1173 bp, Homo sapiens
aaagaggatgttgaggcttgttttttcttcggacccaagggtgctcgggagccctccagtctctgcctttctcacacaaggcgtctctgggaaggcagtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagctt

SEQ ID NO: 452223 - DNA, 1080 bp, Homo sapiens
ttcttaaaatgacagtgtctgttggccacatatgcagtctgaactttgctttgcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagctt

SEQ ID NO: 452224 - DNA, 973 bp, Homo sapiens
cttggagccaaacagtcctaaggctcccggaagctctcagataagccatgccacctctcctgacctctgtgtcctcatggggaaagtggggctaacaggaaaatgccctttgctgcatgtccaggggattaaggaaatgggatccctccaagcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagctt

SEQ ID NO: 452225 - DNA, 1042 bp, Homo sapiens
cgtcgcgccgccggctgctgccttcttcctcctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaagaagaggaagaagatttgcctgatgctcaaactgcagctaaaagagcttccagaatttataacacatgagcccccaaaaagccgggactggaatttcctctcaggaccgtgccgggtttatcattgctttgttatttgtaaggactgaaatgtacaaaacccttcaatgggatgtagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagctt

SEQ ID NO: 452226 - DNA, 721 bp, Homo sapiens
  misc_feature (36)..(37): n is a, c, g, or t
ggaggggggcgttggggcgaaagtttagttttggannggcctgggcgactatttcatctttggagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagctt

SEQ ID NO: 452227 - DNA, 1688 bp, Homo sapiens
cgtcgcgccgccggctgctgccttcttcctcctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctacgaactacactaacaaaaaaaagacaaacacaaaacaaaaacaaacggcgaaaaaacaacaaagaaacaacaacaacaaacaacaacacagtcgtgtgtggccgggcgcgcccgcgcgagccccacgagaagagcgctttgaagaaaacacactcgcgcggtgggagcggagagacggggcccacaagcggaggagcaagagcgaaaaacacgggcgacaaccacggttgtccacaaagagaaaaaccgcgggagagaaaccacaaacagagggggcgtaacccacaaaaaaaaaaaaacacgcgcgggggggaaaaacaacgaggtgaaagagaaaaaaacacacacaaacagacgaaaacaaaggaggacaaacagagcaggggctaacaaagaaggggaccaaaacaaggagccagaaaatataaaataacccccccggggtgaaaagcaagaagggaacaagacagaagggagagcaacagggggaggaagagagaggagaaagagagagcgaagaagacgcaaaaggaagggggaacaggaaaaaaggagcgggagagggaagtaacagagacaagagaaaaaaagacaagacacaagaaggcagaaaggaagagagggggaagggagacaaagaaagaacaagaggggggagagagaaagaagagagaaggagagaggggcgggacgagggcgggggaggagggaacgggaagggacgggagaaggagggagaggaaagaaaggaccgaaagggagcgagggagagaaagaaagaaaaagaaagaagggagaagggaggagagagaagaggaagaaaaaaaaggaaagaaaagaaagaagaggaggagagggcagagggaacagagaggagaagtaggcaaaagaaagagaaaaggcaaaggaaaaggcgggcagaggc

SEQ ID NO: 452228 - DNA, 820 bp, Homo sapiens
cgtcgcgccgccggctgctgccttcttcctcctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaggattattattacctcgaaggttttgtcttgacggatttgagcgcttttgctgcggg

SEQ ID NO: 452229 - DNA, 1113 bp, Homo sapiens
aaagaggatgttgaggcttgttttttcttcggacccaagggtgctcgggagccctccagtctctgcctttctcacacaaggcgtctctgggaaggcagtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtgttttattaactgcttcaccagtaaattttgcatgatggctaagctaacataaaaaaagaataataataacttggaagttttagtttacaaaacagagattccttcaacactggacacgtcgagcattttgtagcttaattaaacctcatgtaaggccacaaggtgaaacgtatcacactaccttttaccttgtaagtgtttgctctgcctctctggtgagtggacgcatgtccacaggtcacttggtaaattaactcaaacatgagttgatccggcaaacccaggctactgggggtatggcctgccagtcgccttttgggttaaatatttctcgagagcaagttcagtgctggaaaaagaaaatgaatcactgacagcctctaaagacttgggaagctt

SEQ ID NO: 452230 - DNA, 627 bp, Homo sapiens
cgtcgcgccgccggctgctgccttcttcctcctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagaagtgaagcgaagccgaaaaaggcagcagcgaaggataaatcttcagacaaaaaagtgcaaacaaaagggaaaaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttctagtagctctagaaacat

SEQ ID NO: 452231 - DNA, 1419 bp, Homo sapiens
gacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctccacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattaaaaagtgtaaggtttgtttattccagaagaccctcacccttaccccattccaaatctcagggagcaccagtctcatagtccttggatttttttaaaaaaaatttttggtcccgttacctctaatgaatttattctgaaatatgtatcgtaggtgctcctaccactttagtctgagtgaagctaactctactagttc

SEQ ID NO: 452232 - DNA, 1222 bp, Homo sapiens
gacaatgccatccttcatattcctccaaccaaagcaagcacagcacatgggagaagggcatttggcatctgctgcccccagggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctccacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtatt

SEQ ID NO: 452233 - DNA, 1451 bp, Homo sapiens
  misc_feature (62)..(62): n is a, c, g, or t
  misc_feature (67)..(67): n is a, c, g, or t
  misc_feature (88)..(88): n is a, c, g, or t
gcagggaacaatacctgggcaaccttgggcagccgcattccaggtgcctttctgctctgtgntcaanatgtgacagtagcctgagtgntggtgccacccggctggacaggattggtcttcctcatccaccacttctggttcctttcatctggaaagaagacctcttccatcttccatgcagctagcagtcatcaggggagacaccctgcggggctttgattctacagatctttctcaaaggaagcttaggacccgtgggaatggcaaaacagttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctccacgctccaagcttggaaagagctgtgttttggttcaaagacaagggaaatggcaaacaaaagactgtaggagagccaaacctcataattatgtgtgttccagaaaactctaaatataacagaccctacagggggccacctggagtttgtcacctatttattcacaggatctgtgaatattgctccatagaaaacaaattgttatgattgagtgggtatacctttgtgattctgtctagtgaaaatgggacatttttaatagtgccagaaagattgataaataaatattttttacaagataagatacaatttttgtatctcaataccttttaaaataaatgccagcagtattaaaaagtgtaaggtttgtttattccagaagaccctcacccttaccccattccaaatctcagggagcaccagtctcatagtccttggatttttttaaaaaaaatttttggtcccgttacctctaatgaatttattctgaaatatgtatcgtaggtgctcctaccactttagtctgagtgaagctaactctactagttc

SEQ ID NO: 452234 - DNA, 4552 bp, Homo sapiens
ggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccaatgtctcttggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttcatttgtttacatacgttgcttcagtcttctcaggtgaaagtagtgagaaaaccgtgaaagaggggggaaacatttatccattatatgctgtttcactggaagtgttaccagcagtccacagaactaatgtgtccccacagacttctcaatcctctccacaccgaagtgcaaaaccacagcagggagatgtgcagggagatgtggagcaaaacacagccaatttgccctcacctcaacatgcttttgaatgcaatataccactgttttacgacctaagatctacacaccttaaaaaccctaaagtaaaataaaggaatagtgt

SEQ ID NO: 452235 - DNA, 2489 bp, Homo sapiens
tttttttttttacctttcccctcctccctcctgcagtctagccaccctatgaaaattatctaataggcagagtggtaccttaatccaagaaagatttggagccacttgcagtaactttttcttttcccagataaagttctaatactcaaaaaagaagagttgatttaagtcccatatccttcaggaatgaggtataggatataaataaattcaaagtaccacattctaagatatttcactaaacattggaatgaatttttcccctttatgtactttaaaatatagaaaatatgcagttatgactagaaatagctgtaatattgtacctgcagagttgagtatctcactagtataatttataattataacctattctgatttcttttcaaatattaggtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttcatttgtttacatacgttgcttcagtcttctcaggtgaaagtagtgagaaaaccgtgaaagaggggggaaacatttatccattatatgctgtttcactggaagtgttaccagcagtccacagaactaatgtgtccccacagacttctcaatcctctccacaccgaagtgcaaaaccacagcagggagatgtgcagggagatgtggagcaaaacacagccaatttgccctcacctcaacatgcttttgaatgcaatataccactgttttacgacctaagatctacacaccttaaaaaccctaaagtaaaataaaggaatagtgt

SEQ ID NO: 452236 - DNA, 490 bp, Homo sapiens
ttttacctttcccctcctccctcctgcagtctagccaccctatgaaaattatctaataggcagagtggtaccttaatccaagaaagatttggagccacttgcagtaactttttcttttcccagataaagttctaatactcaaaaaagaagagttgatttaagtcccatatccttcaggaatgaggtataggatataaataaattcaaagtaccacattctaagatatttcactaaacattggaatgaatttttcccctttatgtactttaaaatatagaaaatatgcagttatgactagaaatagctgtaatattgtacctgcagagttgagtatctcactagtataatttataattataacctattctgatttcttttcaaatattaggtgtcctagttgcctatgaaggtttgccacttcatcttgcactgttccccaaactttggactgagctatgccagactcaggtaaagaaaatgagttttaga

SEQ ID NO: 452237 - DNA, 4143 bp, Homo sapiens
ggctgatgacgactggtggccaatgcagatactaattaagtgccctaatcaaattgtgagacagatgtttcagcgtttgtgtatccatgtgattcagaggctgagacctgtgcatgctcatctctatttgcagccaggaatggaagatgggtcagatgatatggatacctcagtagaagatattggtggtcgttcatgtgtcactcgctttgtgagaaccctgttattaattatggaacatggtgtaaaacctcacagtaaacatcttacagagtattttgccttcctttacgaatttgcaaaaatgggtgaagaagagagccaatttttgctttcattgcaagctatatctacaatggtacatttttacatgggaacaaaaggacctgaaaatcctcaagttgaagtgttatcagaggaagaaggggaagaagaagaggaggaagaagatatcctctctctggcagaagaaaaatacaggccagctgcccttgaaaagatgatagctttagttgctcttttggttgaacagtctcgatcagaaaggcatttgacattatcacagactgacatggcagcattaacaggaggaaagggatttcccttcttgtttcaacatattcgtgatggcatcaatataagacaaacttgtaatctgattttcagcctgtgtcgatacaataatcgacttgcagaacatattgtatctatgcttttcacatcaatagcaaagttgactcctgaggcagccaatcctttctttaagttgttgactatgctaatggagtttgctggtggacctccaggaatgcctccctttgcatcttatattctgcagaggatatgggaggtgattgaatacaatccttctcagtgtctagattggttggcagtgcagacaccccgaaataaactggcacacagctgggtcttacagaatatggaaaactgggtcgagcggtttcttttggctcacaattatcctagagtgaggacttctgcagcttatcttctggtgtcccttataccaagcaattcattccgtcagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctattttagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtctgtgctgactgtccagagaatatccgccttattgttcagaacccagtggtaaccaagaacattgccttcaattacatccttgctgaccatgatgatcaggatgtggtgctttttaaccgtgggatgctgccagcgtactatggcattctgaggctctgctgtgagcagtctcctgcattcacacgacaactggcttctcaccagaacatccagtgggcctttaagaatcttacaccacatgccagccaataccctggagcagtagaagaactgtttaacctgatgcagctgtttatagctcagaggccagatatgagagaagaagaattagaagatattaaacagttcaagaaaacaaccataagttgttacttacgttgcttagatggccgctcctgctggactactttaataagtgccttcagaatactattagaatctgatgaagacagacttcttgttgtatttaatcgaggattgattctaatgacagagtctttcaacactttgcacatgatgtatcacgaagctacagcttgccatgtgactggagatttagtagaacttctgtcaatatttctttcggttttgaagtctacacgcccttatcttcagagaaaagatgtgaaacaagcattaatccagtggcaggagcgaattgaatttgcccataaactgttaactcttcttaattcctatagtcctccagaacttagaaatgcctgtatagatgtcctcaaggaacttgtacttttgagtccccatgattttcttcatactctggttccctttctacaacacaaccattgtacttaccatcacagtaatataccaatgtctcttggaccttatttcccttgtcgagaaaatatcaagctaataggagggaaaagcaatattcggcctccgcgccctgaactcaatatgtgcctcttgcccacaatggtggaaaccagtaagggcaaagatgacgtttatgatcgtatgctgctagactacttcttttcttatcatcagttcatccatctattatgccgagttgcaatcaactgtgaaaaatttactgaaacattagttaagctgagtgtcctagttgcctatgaaggtttgccacttcatcttgcactgttccccaaactttggactgagctatgccagactcagtctgctatgtcaaaaaactgcatcaagcttttgtgtgaagatcctgttttcgcagaatatattaaatgtatcctaatggatgaaagaacttttttaaacaacaacattgtctacacgttcatgacacatttccttctaaaggttcaaagtcaagtgttttctgaagcaaactgtgccaatttgatcagcactcttattacaaacttgataagccagtatcagaacctacagtctgatttctccaaccgagttgaaatttccaaagcaagtgcttctttaaatggggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgaaaatagttctgttaaagaataccgaatggaagttccatcttcgttttcagaagacatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgt

SEQ ID NO: 452238 - DNA, 1778 bp, Homo sapiens
gaaagaatggattcctgggaaaataaacatctgcaattaactgtaaacaactgcatcaaagtgttggctttagaatttgaaatgttcctatctgggtttttgtaggacctgagggcactcgctttgctcctgtcagtacacactcccaaacagttaaacccagctctaattccaactctgcaagagcttttaagcaaatgcaggacttgtctgcaacagagaaactcactccaagagcaagaagccaaagaaagaaaaactaaagatgatgaaggagcaactcccattaaaaggcggcgtgttagcagtgatgaggagcacactgtagacagctgcatcagtgacatgaaaacagaaaccagggaggtcctgaccccaacgagcacttctgacaatgagaccagagactcctcaattattgatccaggaactgagcaagatcttccttcccctgcatgtcaaatatcaggtcacagcatgcagaagaacagtccaacaatggtagatatgacgattgtaaagaatttaaagacctccactgttccaaggattctaccctagctgaggaagaatctgagttcccttctacttctatctctgcagttctgtctgacttagctgacttgagaagctgtgatggccaagctttgccctcccaggaccctgaggttgctttatctctcagttgtggccattccagaggactctttagtcatatgcagcaacatgacattttagataccctgtgtaggaccattgaatctacaatccatgtcgtcacaaggatatctggcaaaggaaaccaagctgcttcttgacattaggtgtagcatgtctacttttaagtccctcacccccaacccccatgctgtttgtataagttttgcttatttgtttttgtgcttcagtttgtccagtgctctctgcttgaatggcaagatagatttataggcttaattcttggtcaggcagaactccagatgaaaaaaacttgcatcttcagtatacttcctaaagggcaatcagataatggatatgttttatgtaattaagagttcactttagtggctttcatttaatatggctgtctgggaagaacagggttgcctagccctgtacaatgtaatttaaacttacagcatttttactgtgtatgatatggtgtcctctgtgccagttttgtaccttatagaggcagattgcctccgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataattgttttatttttattgacatgactgattgattgattgctattctgtgcacttaattaaactgattgtgatgacttttcatttgtttacatacgttgcttcagtcttctcaggtgaaagtagtgagaaaaccgtgaaagaggggggaaacatttatccattatatgctgtttcactggaagtgttaccagcagtccacagaactaatgtgtccccacagacttctcaatcctctccacaccgaagtgcaaaaccacagcagggagatgtgcagggagatgtggagcaaaacacagccaatttgccctcacctcaacatgcttttgaatgcaatataccactgttttacgacctaagatctacacaccttaaaaaccctaaagtaaaataaaggaatagtgt

SEQ ID NO: 452239 - DNA, 5238 bp, Homo sapiens
caacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcagctcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctactgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaaaaaaaaaaaaaaaaaaaaaaaaaaaaaaaaaaaaaacacgaacagaaagaacaagaaaaacaaaagaagcggaaggacgcaccagcaagaagacgacccacgcagaggggacgcaacaggcttcgcacggcaccgagcacaggctgtggtggtgacaacaagaggaccctccacaaagcgagggacgcaacatgcaacacaagaccagagcgagccgagtgtgcaaacaacacccacagcgcatagactaacaccgcccagacgggactaccatgttggagaggacaaccctcaactatgagaggggaccaccagggaccacaatccaccaccgaactagcatcgggagcaacaaaaaaagaaatcacacatggaagagcacagacacaactgcgggtcagcgcgcacaacggacacgcgcgtagctgacccacatatcggcacaacctggatgcaaaacagaagggagcacgacagcaccacaacaaacaacgagaagcgaggaggagaagagaaggacgcgccgcgagccaagatgacccaacggcgggagcgacgccgcggcgaagagacacgaagcgcacagagagcagcgaagaaacagaaacgagccatccca

SEQ ID NO: 452240 - DNA, 4493 bp, Homo sapiens
caacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcagctcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctactgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452241 - DNA, 4565 bp, Homo sapiens
caacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcagctcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctactgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgttgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452242 - DNA, 2205 bp, Homo sapiens
agatgcaccattttatctcctagtgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452243 - DNA, 2584 bp, Homo sapiens
gtaaacgacggtcagatgttgtccgtcttcgttgccctacacttgtatgctagtgtcgcaaattgctggacttgtatagtactgaaatttgagagaatcctcttttgaaaagaatagaattgggtacagttcagatttttagtttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgctggttgttcccaagtgagagttgctggcaaatgataaagcaggcaggaaaaatgttcctgaatgttaattgaagttcacatacattcttgttttgagatgagttttttgggggtggaggaaaggagacgtggaacaaagtagtatggccacaaccaaaccaaaaaagaccccccttttttttcctaggagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452244 - DNA, 4313 bp, Homo sapiens
caacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcagctcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctactgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagaaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttaatgtgcttgagatgcttggactttatctttttaacatgaagcgtcgcaacatcttggtgaggtcacagtctgctacatccagattacacatattactcacttctgagcctaatagagagctgacttgctctgagatgcagacatgctatcgactctaagtgtgcttgaccggagtactgactatgcgatatgtgttgtagaagtcagaaactggcactgatctagattgcgggatgtagatgagcat

SEQ ID NO: 452245 - DNA, 1068 bp, Homo sapiens
agaatccttttgtgtctgtagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452246 - DNA, 379 bp, Homo sapiens
actctggtctgcctgtgggatttacagccatgatgcacatctctttgttttatagaggtggaaattaaagttgtcgtctttagttccctgcattgagctgtgccactttgcttgaattggtggactgaaatttgagagaatcctcttttgaaaagaatagaattgggtacagttcagatttttagtttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgct

SEQ ID NO: 452247 - DNA, 525 bp, Homo sapiens
ggcaggaaaaatgttcctgaatgttaattgaagttcacatacattcttgttttgagatgagttttttgggggtggaggaaaggagacgtggaacaaagtagtatggccacaaccaaaccaaaaaagaccccccttttttttcctaggagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgagttggaattcctggtttcacttttgttacctgcagtggtgaggaggcttattgttttggatttgatgctttttgtattgaatgtcaccttggtgatcttgactag

SEQ ID NO: 452248 - DNA, 4619 bp, Homo sapiens
caacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcagctcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctactgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452249 - DNA, 3736 bp, Homo sapiens
agtgtattgattattgttggaagctgtagggttttactttctgtttttcctccccaagattttccactggaattgtgatcaagataacattaaaccttttaggctaaggtctttataaagtttttagccttcccatatatgtattcagatctttgctcccaatttttttttttttctgagatggagtcttactctgttgcccaggctggagtgaggtggcccagtctccactgactgcaacctctgtctcccaggttcaagtgattctcctgagtcagcctccagagtagctgggactacagatgcttgccaccacatccgggctaatttttttggtatttttagtagagacagggtttcaccgtattacccaggatggtctcgatctcctgacctcatgattgtcctgcctcggcctcccaaagtgctgggattacaggtgtgagccaccgcgcccagcctcctcccattctttcggtgtttgacttgggtgttctcctatagaattaatacatactaggtatggtagaattcttatttttagtcactggccttactgttccttaaacatttcaagtttttgccttagggcctttgcatttgctgatatctctgtctggaacattcagcgcccaaataatcaggtggtttgccccttctgtacccatagttaatgtacacagcttgctagcttactacatttatgtcatgcttattccttgaccctccccacccaaatggtgcccccccttccatcactctcctcttacccttctttatttctcttcacagcatttgtcagtactttacattattccatactagaaggtgagtgtcagttctattagaacaggaacttggtcttattccctcctatatttcggtgcccagaatagcacttggcacacagtcttttgagtgagtggatgaccttgtgcacaatcagttattatcattgaacttcggtaaagcattaattgtggcatctttgtcagatgtttagataagatggttggcgtacgcatagtctgcatgttgtatttttagtctttgaagatatgaagtcaggtaagcaacatcctaacatagtctatttcttgacatctcttacaaacgtagagtatagcctatcctcaggtgtgtgctgaagtttatattagggcttttgggtaccttagaatgtgggtattgcaatctttattcaggatgttatcagtcactggtacagttagtcttgttattaaaagaaaaaagaaaaaaaaacaggtagaagttggaattagccttcgtaggaagaattccagatgcaaatgcaggaaaaactctgttgtccttggaaactactctggagagagttattggcactataattcccaaacctaccctgttaaaagattctgtggaaatgggttaacctttataccttttaagatattgatcttaatgatgttttacaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452250 - DNA, 2395 bp, Homo sapiens
gatattttttcttaatgtgttctattccagtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452251 - DNA, 4565 bp, Homo sapiens
caacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacaccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcagctcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctactgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaatctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452252 - DNA, 1074 bp, Homo sapiens
ggccttgacaacgatcacaccgtctagtggtatccatgctgaactgtccctgtccctcactggggtgattgcattaaatattgggctttccatcaacacaacacatcacactgtgcgcatctacgaggggtatgccctcctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaa

SEQ ID NO: 452253 - DNA, 3204 bp, Homo sapiens
aaaacatacttgacaacatggctaatgtaacatactctaccacttggtctgaagcccagcagtatctgatggataatccaacttttgcagaagatgaggagttacaaagtaagaataatggctaagtaagagaaatagttttaaacagcgtcctccagcagcaaagaattattttcactttttatatgagataactaattgaattttatgcagttgtttatttctgaaaaagagttttatttatttccaaataggatatttctttctgattgagtttgtgattcatgacaaaatattttttcaaatttaaagtagctttatcaggtaatccttgaaatatttaaattataggtcacatttgaaattctgcttagccgtttgtatgtaacttggtaagaactaaatgaattaccgcattttactcaggttgttttcttgaggtaataacattatagattttgtaaaaagagaaaaaagtattagaattatcttaacattaggcttccctaagtactctttctgagttaaccaattgctttttaaattatagctttatcagctacccctctaaaaatcatgcttcagtagatttttttatagggtgtacagttctatactttgaaaagctcctggaataattatgatattgcaaacagattttatcataacacttttcattagttttgccatatgcacgtcctttgttttatcctatgacatgtttcagaattcttttattgagttctttgtgaaattttccttaaaactttcctatgcagatgatcacaaatcatatttgagtttaaatacaagtttgtttgtttgtttgtttagagacggggtcttgctgtgctgcccaggctagtcttgaactccggggctcaagcaatcctcccacctcagccttccaaagtgttgagattacaggcatgagccaccacaccctagcctaactacaagtatttttgacaggtgattttgaaattttgggggagctaatgcaagtaaactactttacttgttgacatttgacactctaaattttaactggcaaatactttagatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtg

SEQ ID NO: 452254 - DNA, 2249 bp, Homo sapiens
aaaacatacttgacaacatggctaatgtaacatactctaccacttggtctgaagcccagcagtatctgatggataatccaacttttgcagaagatgaggagttacaaaatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtg

SEQ ID NO: 452255 - DNA, 3494 bp, Homo sapiens
aaaacatacttgacaacatggctaatgtaacatactctaccacttggtctgaagcccagcagtatctgatggataatccaacttttgcagaagatgaggagttacaaagtaagaataatggctaagtaagagaaatagttttaaacagcgtcctccagcagcaaagaattattttcactttttatatgagataactaattgaattttatgcagttgtttatttctgaaaaagagttttatttatttccaaataggatatttctttctgattgagtttgtgattcatgacaaaatattttttcaaatttaaagtagctttatcaggtaatccttgaaatatttaaattataggtcacatttgaaattctgcttagccgtttgtatgtaacttggtaagaactaaatgaattaccgcattttactcaggttgttttcttgaggtaataacattatagattttgtaaaaagagaaaaaagtattagaattatcttaacattaggcttccctaagtactctttctgagttaaccaattgctttttaaattatagctttatcagctacccctctaaaaatcatgcttcagtagatttttttatagggtgtacagttctatactttgaaaagctcctggaataattatgatattgcaaacagattttatcataacacttttcattagttttgccatatgcacgtcctttgttttatcctatgacatgtttcagaattcttttattgagttctttgtgaaattttccttaaaactttcctatgcagatgatcacaaatcatatttgagtttaaatacaagtttgtttgtttgtttgtttagagacggggtcttgctgtgctgcccaggctagtcttgaactccggggctcaagcaatcctcccacctcagccttccaaagtgttgagattacaggcatgagccaccacaccctagcctaactacaagtatttttgacaggtgattttgaaattttgggggagctaatgcaagtaaactactttacttgttgacatttgacactctaaattttaactggcaaatactttagatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaatctttctcttgcttttttttccctgctattgaggaagtattttgccttccctactcactgagaagtattgacttcgtggtacacattctaaagcatttctgatttgaatatttttgtacatttttatcaattattaaaccttctcttctagtgaaaaaaagtatttatttctacttaaactgctcagctctaaagaaattgtatgatcactttaaaggtactaaatccctgaaattttgcttcatcttacccacaccgctagtttactttccttttttaatatttaagaatattataaatcagtgcatttgaggtccctagatttgtttttcacctatgaattttttacagactattttagagaggctgtggtttgaagacagaatactctttacatgctaacttttgaaggttggtaatgtaatttatactattttccttcagtgcaggagattttttaagtaaataagtaaattttagcacctattcttcggta

SEQ ID NO: 452256 - DNA, 1694 bp, Homo sapiens
cagacctgttgaattacattctttttatttgaatttgtgcatatctaatgaataaccatttaagcactaacgttaaattttaaataattcctactcagcaatttcaagaaaataattttattaatacagctgtctgccttatgtgttaaagctaacagcagtatactatgtacatatataaaccaatattatattgagttggtgagaaatgtagtatctgtctgtatttacataatagatactacacatctattatgtggtagtaagtctcatgagtggtattttatccttcagaatattatccttcccaagggaaagctgtccccatgaatcttgggtaaattttactaaatccttgaggttaacaattcacattttatttcatctctctaagagcacataacctgttacacatggatgttcttaaatattacctatataagaatggtatcttcatcaaaatgctaacctgttattttctattcatacaggactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtg

SEQ ID NO: 452257 - DNA, 1384 bp, Homo sapiens
gcaggagaattgcttgaacccaggaggcagaggttgcagagagccgagatcgtgccactgcactccagcctgggtgacaagaacaagactctgtctcaacaaaaaaattagcaaggaatgtattatctaggaaatgaatacctggcttccattaaatggaaatattgcttcatattcacacagtctttaaaccctgtgaaatgtgtttctttggaagagagtttatatagatattggattcttttttcaaaggctcagcccgtaaacctctgagtactgatgtcaactataattgtaatcaatgtcttttcagggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtg

SEQ ID NO: 452258 - DNA, 3033 bp, Homo sapiens
aaaacatacttgacaacatggctaatgtaacatactctaccacttggtctgaagcccagcagtatctgatggataatccaacttttgcagaagatgaggagttacaaagtaagaataatggctaagtaagagaaatagttttaaacagcgtcctccagcagcaaagaattattttcactttttatatgagataactaattgaattttatgcagttgtttatttctgaaaaagagttttatttatttccaaataggatatttctttctgattgagtttgtgattcatgacaaaatattttttcaaatttaaagtagctttatcaggtaatccttgaaatatttaaattataggtcacatttgaaattctgcttagccgtttgtatgtaacttggtaagaactaaatgaattaccgcattttactcaggttgttttcttgaggtaataacattatagattttgtaaaaagagaaaaaagtattagaattatcttaacattaggcttccctaagtactctttctgagttaaccaattgctttttaaattatagctttatcagctacccctctaaaaatcatgcttcagtagatttttttatagggtgtacagttctatactttgaaaagctcctggaataattatgatattgcaaacagattttatcataacacttttcattagttttgccatatgcacgtcctttgttttatcctatgacatgtttcagaattcttttattgagttctttgtgaaattttccttaaaactttcctatgcagatgatcacaaatcatatttgagtttaaatacaagtttgtttgtttgtttgtttagagacggggtcttgctgtgctgcccaggctagtcttgaactccggggctcaagcaatcctcccacctcagccttccaaagtgttgagattacaggcatgagccaccacaccctagcctaactacaagtatttttgacaggtgattttgaaattttgggggagctaatgcaagtaaactactttacttgttgacatttgacactctaaattttaactggcaaatactttagatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctgtaagtatttagaattgtttcatgcctgtattttcaaaatgcaaaaatgtattctgtggttaaaccatgatggtgttgaaagaataggcttttttccaggtgtgctaccattgaagaaaacagtgaaaattcagttaagtacatttcacacaatatcatagtttttggtcatgcatgatcctagattttattctcctaaatttgatattttttaaatatagcatttcataactatagccttattaactcactaagaaaggatatggtcactaagaagtgccactggacattttttacctaattttcaaattttttttttaagtgagagactaaatctgggattctacagatgtctacagttgtcactgttattaaatcctttgtttcaaaaggtagcaattccagtaacttttagaaatactgatttggggtggaggaagggcaaataaataggagaggagaatataagccaaagttagtatttcaataacagattacataattagtccttttcaaatatatgtatatatgaatgacagagcctaataatgcaaatgctgtgggtttagcaagggtaaatgcctatgaatcatcactggagagcataaactatgtaggtaaaaccctattagggatctctggatattctgattcgttggtatagggtgggtttttttttagagctgaaacaggtgagtctgagtcacatcgtaagtgaagagtgaatgtttcctttgtactttctagcagcttatggtgggttaaatgaaatccctggagtgaatgaaagaggacgatatgggaactatccacttttcaaaggttgtgtcttacggtgcagtattatttttgtttgttcagcctaaatcttgtcctgctcattagtcttgtgtatttatt

SEQ ID NO: 452259 - DNA, 755 bp, Homo sapiens
aaaacatacttgacaacatggctaatgtaacatactctaccacttggtctgaagcccagcagtatctgatggataatccaacttttgcagaagatgaggagttacaaaatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagtatgtagtcggaagtatgtagtcggaagtatgtagtccggaagtatgtagtcaggaagtatgtgtcggaatatgtagtacgaagttgtatgggatcttaaatgactgaggtgagtgagggggtataaaaaaa

SEQ ID NO: 452260 - DNA, 3547 bp, Homo sapiens
aaaacatacttgacaacatggctaatgtaacatactctaccacttggtctgaagcccagcagtatctgatggataatccaacttttgcagaagatgaggagttacaaagtaagaataatggctaagtaagagaaatagttttaaacagcgtcctccagcagcaaagaattattttcactttttatatgagataactaattgaattttatgcagttgtttatttctgaaaaagagttttatttatttccaaataggatatttctttctgattgagtttgtgattcatgacaaaatattttttcaaatttaaagtagctttatcaggtaatccttgaaatatttaaattataggtcacatttgaaattctgcttagccgtttgtatgtaacttggtaagaactaaatgaattaccgcattttactcaggttgttttcttgaggtaataacattatagattttgtaaaaagagaaaaaagtattagaattatcttaacattaggcttccctaagtactctttctgagttaaccaattgctttttaaattatagctttatcagctacccctctaaaaatcatgcttcagtagatttttttatagggtgtacagttctatactttgaaaagctcctggaataattatgatattgcaaacagattttatcataacacttttcattagttttgccatatgcacgtcctttgttttatcctatgacatgtttcagaattcttttattgagttctttgtgaaattttccttaaaactttcctatgcagatgatcacaaatcatatttgagtttaaatacaagtttgtttgtttgtttgtttagagacggggtcttgctgtgctgcccaggctagtcttgaactccggggctcaagcaatcctcccacctcagccttccaaagtgttgagattacaggcatgagccaccacaccctagcctaactacaagtatttttgacaggtgattttgaaattttgggggagctaatgcaagtaaactactttacttgttgacatttgacactctaaattttaactggcaaatactttagatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtgaaaaaaagtatttatttctacttaaactgctcagctctaaagaaattgtatgatcactttaaaggtactaaatccctgaaattttgcttcatcttacccacaccgctagtttactttccttttttaatatttaagaatattataaatcagtgcatttgaggtccctagatttgtttttcacctatgaattttttacagactattttagagaggctgtggtttgaagacagaatactctttacatgctaacttttgaaggttggtaatgtaatttatactattttccttcagtgcaggagattttttaagtaaataagtaaattttagcacctattcttcggta

SEQ ID NO: 452261 - DNA, 1798 bp, Homo sapiens
  misc_feature (30)..(30): n is a, c, g, or t
cattcttctagtgcagagtctgagagaagntataaaaagtcaaaaaagcataagatgaaaagtaagatatctaaaaaacatcataggaaacgttcccgctctcgatcggggtcagattcagatgatgatgatagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtg

SEQ ID NO: 452262 - DNA, 1190 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcat

SEQ ID NO: 452263 - DNA, 910 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgaggtgagagagagctaggcttagggacgcctcggactcagtttgaccctaactagccttgcatcttcaggcaaatcacactctttccatctcaggtttgtttgtttttaatctcaattgaagatgaattatttagattaggtatctttttctctaggaggattctatgaccacattacc

SEQ ID NO: 452264 - DNA, 1823 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452265 - DNA, 1555 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaaggtcgaagaagagcagaaggtcgaccagataga

SEQ ID NO: 452266 - DNA, 1710 bp, Homo sapiens
tggcaggatgaggcgtgggtgaatcggacgaggcgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452267 - DNA, 1541 bp, Homo sapiens
tagaggatccccgtcggatgcaagtgtcccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452268 - DNA, 1526 bp, Homo sapiens
gatctgagcgatcccgtaattacttacccagttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452269 - DNA, 1908 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgtgtaagtgtgaccttcaattcggatgttgcccaagagttgaacacctctattgctgtagtgatgggactagaggctgcatggtgagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452270 - DNA, 1366 bp, Homo sapiens
gagacagtgataatgaaagctaagcctcgggctaatttccccatagccgtggggtgacttccctggtcaccaaggcagtgcatgcatgttggggtttcctttaccttttctataagttgtacctgggttaggtctacctggccaggtagacctaactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452271 - DNA, 1328 bp, Homo sapiens
tgcactgagtggagattgcaccactgcatgccagcctgagtgggagtgagaccttgtctcaaaaaaaaaagcatcccattaaataatgaattgagcatccaagtttggggtttattatatcgatataacgcacgatggtgtcttgactctcctgcttttatcccccattagtgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452272 - DNA, 274 bp, Homo sapiens
gtaggagtcagcttcttgttggcttccaactgctacttaattggaaaagatttcctctctcttggtgcttaaacctggttctaacctggtgccaggttatttttggttgtgttccttctagacttatcactgtttataattatttctactttctccaggggtttttcttcttctttagtatagggtctattatcccagtctttaccattgcttttcaacagctttgggtctgaatttatacaagcttcaaatatactgattcatttcattctag

SEQ ID NO: 452273 - DNA, 450 bp, Homo sapiens
ccgcatcctagccgccgactcacacaaggcaggtgggtgaggaaatccaggtaaggctcctgacagcagctttagaagggtacttgctggagtgaattcgggcctctgattgctatataaagttgtaggcaatcaagcaacagagaactgcaagtttccaaaggcaatgaagtaggatacggaagggaaatcatggaatttccacaaaagtcttactggggcctttctttggctagagctggcacagtgtgacgttcccgagttagttcagagaaatgctttctcttttgcgaaacaaaatttccaagagtaggtgaatcctaggatttttcaagcctgggacagggtccagggattttcgtctcagtcaccatctaaagctttctttcccacgggctaaagcaaagccccataggcttctccactatgacacctcagctcggattgccc

SEQ ID NO: 452274 - DNA, 1192 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttggggggtggtcccgggttatttcctcccaaaaaaaagagcacaacaacacaacaacaacatcacaacagcaaaaacaacaagaagagaggacaaacaaagcaactagagacaaacaaggcacgacgaaaagcccacaccacgacaagggcaacgaacgcagaaaaaaaagacgagagacgggacaaacacgcgacaacagaacaaagtacagaagacaacacaacgagaaatacagaagctacccaca

SEQ ID NO: 452275 - DNA, 1659 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgccgggagggagcattcagccgggaggagcattcagccgggag

SEQ ID NO: 452276 - DNA, 1805 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452277 - DNA, 1911 bp, Homo sapiens
agattcacaaggccaacagacaacccaaagtcattaagccatgagagtggaatgaatctatgaaaactcaatgaagacagaacaagagaaaaatcttttcagccacgatgaattaggagaacaagatgtcaaattacactgatgctgagtcaagcttctcaaagcaagagataatcaggctgacctattgctgaggactatgagaaaaaagttattacagaatgagtcatatggaaaacacttgcaaacagaagaatattgagaacataagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttgggggtgttctgttttctccaacttggtctttcacagtggttcgtttaccaaataggattaaacacacacaaaatgctcaaggaagggacaagacaaaaccaaaactagttcaaatgatgaagaccaaagaccaagttatcatctcaccacaccacaggttctcactagatgactgtaagtagacacgagcttaatcaacagaagtatcaagccatgtgctttagcataaaagaatatttagaaaaacatcccaagaaaatcacatcactacctagagtcaactctggccaggaactctaaggtacacactttcatttagtaattaaattttagtcagattttgcccaacctaatgctctcagggaaagcctctggcaagtagctttctccttcagaggtctaatttagtagaaaggtcatccaaagaacatctgcactcctgaacacaccctgaagaaatcctgggaattgaccttgtaatcgatttgtctgtcaaggtcctaaagtactggagtgaaataaattcagccaacatgtgactaattggaagaagagcaaagggtggtgacgtgttgatgaggcagatggagatcagaggttactagggtttaggaaacgtgaaaggctgtggcatcagggtaggggagcattctgcctaacagaaattagaattgtgtgttaatgtcttcactctatacttaatctcacattcattaatatatggaattcctctactgcccagcccctcctgatttctttggcccctggactatggtgctgtatataatgctttgcagtatctgttgcttgtcttgattaacttttttggataaaaccttttttgaacagaaaaaaaaaaa

SEQ ID NO: 452278 - DNA, 1210 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctctcaagttgctgaagactgaattgtaaagaaaaaaaatctccaagcccttctgtctgtcaggccttgagacttgaaaccagaagaagtgtgagaagactggctagtgtggaagcatagtgaacacactgattaggttatggtttaatgttacaacaactattttttaagaaaaacaagttttagaaatttggtttcaagtgtacatgtgtgaaaacaatattgtatactaccatagtgagccatgattttctaaaaaaaaaaataaatgttttggggggtggtcccgggttatttcctcccaaaaaaaagagcacaacaacacaacaacaacatcacaacagcaaaaacaacaagaagagaggacaaacaaagcaactagagacaaacaaggcacgacgaaaagcccacaccacgacaagggcaacgaacgcagaaaaaaaagacgagagacgggacaaacacgcgacaacagaacaaagtacagaagacaacacaacgagaaatacagaagctacccaca

SEQ ID NO: 452279 - DNA, 716 bp, Homo sapiens
taatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcaggtgggtgaggaaatccagagttgccatggagaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaacacctttctcctgatggccagtatgtccccaggattatgtttgttgacccatctctgacagttagagccgatatcactggaagatattcaaatcgtctctatgcttacgaacctgcagatacagctctgttgcttgacaacatgaagaaagctcagctctggcagagctctgccaagggg

SEQ ID NO: 452280 - DNA, 1859 bp, Homo sapiens
cctgcctgcacggcacaggagagcaaacttctacagacagaccaaggcttccatttgctgctgacacatggaactgaggtgaaattgtgctccatgattttacagatttcataacgtttaagagacgggactcaggtcatcaaaatgaaagccctcatctttgcagctgctggcctcctgcttctgttgcccactttttgtcagagtggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaaatatgcttcaaaggtcaaacattacaaaagcattagtagtttgtttgtttgtttttgagactgagtctcactttatcacccagactggcgtgcagtggcactatcttggctcattgcaacctctgcctcccaggtcagcctcccaagtagctgggattacaccaccatgcccagctactaaaaatacttgtatttttagtagagacggggtttcaccatgttgaccaggctggtcttgaactcctgacctcaagtgatcttccggcctcagcctcccaaagtgctggattacaggcgtgagccactgagccagccagcattagtaatttttaaaaacactttatcagtattttaaaaatgttaatgcaggagaaaagatatcacaactctatggaaaatgacatttccatttgccttattgctacttcaagctctttaaatcaccatcttccctatttctgcgagtggtattgccatccttgacattt

SEQ ID NO: 452281 - DNA, 911 bp, Homo sapiens
acccaggctggagtgcaatggcatgatctcggctcactgcaaactccacctcccaggttcaattgattcttctgcctcagcctcccacgtagctgtgactacaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaaaaaaaaaaacaacgccaacaccgcagaaagaacaaggggggcaccggggacccttgagc

SEQ ID NO: 452282 - DNA, 2883 bp, Homo sapiens
tacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaa

SEQ ID NO: 452283 - DNA, 2410 bp, Homo sapiens
acggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttttgtatttttagtagagacggggtttcaccgttttagccgggatggtctcgatctcctgacctcgtgatccgcccgcctcggcctcccaaagtgctgggattacaggcgtgagcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaa

SEQ ID NO: 452284 - DNA, 1598 bp, Homo sapiens
  misc_feature (41)..(41): n is a, c, g, or t
catttgctacacattattgaaaacaccccttggggttttantatataagcagtgtcggtcgaaatcggactcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaa

SEQ ID NO: 452285 - DNA, 2396 bp, Homo sapiens
tacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaa

SEQ ID NO: 452286 - DNA, 2337 bp, Homo sapiens
tacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaa

SEQ ID NO: 452287 - DNA, 929 bp, Homo sapiens
gctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccaggtgactcacctccgctaattgttccgtgttcgttcgcctttcactttgtgtgtctcccccgccccacgcttttcgcttatgtgtatgcccccccgccgcgcccccgggctatattgcccaggc

SEQ ID NO: 452288 - DNA, 1104 bp, Homo sapiens
tggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccagaacctgggccctttcctggcattgtggacatgttcggaactggaggtggcctgctggagtatcgggctagtctgctggctgggaagggtttgctgtgatggctctggcttactataactatgaagacctccccaagaccatggagacgctccatctggagtactttgaagaagctgtgaactacttgctcagtcatcctgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcc

SEQ ID NO: 452289 - DNA, 2942 bp, Homo sapiens
tacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaaaaaaaaaaacaacgccaacaccgcagaaagaacaaggggggcaccggggacccttgagc

SEQ ID NO: 452290 - DNA, 2889 bp, Homo sapiens
tacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaaggtaattagaactgacagggaattgtatgattaatgacgtgggacatgagagatttggaacgagataaaaaggcttaccttgaggacagccttattaggagcagaggcaaacacaggttttgtgggtttgaagcctacacatttatagctttctctaattacacaggtaggaaattataaaatcaggtacaagggcttggcaggggcctaaagcttaagtgatgaaaaaaaaaaaacaccacacctctggtgaaaccaatagcttacgaaaaagtagaaaaaagcgcgatgcatggggagctccggtagtcctttgaggtatttgagaggctgagtcaggaagatggcttgagcaccaggagttggaggtttgtaagtgcagtgatggtaaactgccgctgtactccagtctggcaatgtagtgagaccctgtctctcaaaaaaaaaaagtaacccttgcctgactgggacaataattgagaaaccagtaaaacaaaataataactattagccgggcgcggtggctcatgcctgtaaatcctagcattttgggaggctgaggcgggcggattacaaagtcaggagtttgagaaattactacctattaccccatttggctatttttacacttgtaaggaatgaagctcagaggtcacacagctagtaagaagccagcacccttcgatgtgggattgatgtggaggataggcatatacagagaacacaaaagcaaaacaccatggtgcagattttgaaagaaaagccctaagattagtaatgagtgtgaattattcaacaaagtgatcaaaactaactccagctctgcattcctcttcgccatcaggagtttggagcctggagactgctagctgcctggttctttaagaaccagccctggtccagcccattccgcaggccagcaagcttctgaaaagcaaacctaggaagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccattcagttgttctcaggtctgaattcaaaatggcctcatctcctgctgtccttcgagcgtcccggctgtaccaatggagcctgaagagttcggcgcagttcctggggtctccacagctgaggcaggttggtcagatcattagggttcctgctcggatggcggcgacgctgatcctggagcctgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacactcttggcgagctggacctggagcgcgcgcccgcgctgggcggcagcttcgcggggcttgagcccatggggctgctctgggccttggagcccgagaaacctttggtgcggctggtgaagcgcgacgtgcgaacgcccttggccgtggagctggaggtgctggatggccacgaccccgaccccgggcggctgctgtgccagacgcggcacgagcgctacttcctcccgcccggggtgcggcgcgagccggtgcgcgtgggccgggtgcgaggcacgctcttcctgccgccagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagcatagttataataagccagaggcacgagtaatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaa

SEQ ID NO: 452291 - DNA, 1247 bp, Homo sapiens
tacttttcagaactgtattaagaactgtaacagtcactgcgagggtctgcggcttcattcttgatgtcagcgagaccaagaatccaccagaaggaaccaattccagacacagaattatttgccttcttacttcctgagagttctaggcacagaacatacttgaggtgttatacaaagttgttctcaggtctgaattcaaaatggcctcatctcctgctgtccttcgagcgtcccggctgtaccaatggagcctgaagagttcggcgcagttcctggggtctccacagctgaggcagaacctgggccctttcctgggattgtggacatgttcggaactggaggtggcctgctggagtatcgggctagtctgctggctgggaagggttttgctgtgatggctctggcttattataactatgaagacctccccaagaccatggagacgctccatctggagtactttgaagaagccatgaactacttgctcagtcatcccgaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaa

SEQ ID NO: 452292 - DNA, 852 bp, Homo sapiens
acccaggctggagtgcaatggcatgatctcggctcactgcaaactccacctcccaggttcaattgattcttctgcctcagcctcccacgtagctgtgactacaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattcttttgtttttaataactaaagttttttcccctcattattaaaatgaatttaccagtaa

SEQ ID NO: 452293 - DNA, 3182 bp, Homo sapiens
gtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtgtgtatgcgtgcctgtctgtgtgcgggtgtgtgtatgtgcatagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcaggatctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaaac

SEQ ID NO: 452294 - DNA, 2747 bp, Homo sapiens
ggagttgtaattaagctgttagtaaacaggttttttttgctcttataattgctatttttcagaaaaggaaagtataattcgtgatctcaccactgaactacttttactgaaggataccaacttctacgaacctatatattctttcttacaatagtggttgacagttggctcgcaatatgggtcgacgttttgtctaaagtcttgctcttttatctacagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtgtgtatgcgtgcctgtctgtgtgcgggtgtgtgtatgtgcatagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcaggatctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaaac

SEQ ID NO: 452295 - DNA, 3124 bp, Homo sapiens
gtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtgtgtatgcgtgcctgtctgtgtgcgggtgtgtgtatgtgcatagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggtatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcaggatctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaaac

SEQ ID NO: 452296 - DNA, 3097 bp, Homo sapiens
gtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtgtgtatgcgtgcctgtctgtgtgcgggtgtgtgtatgtgcatagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcaggatctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagtgtcaacgtacgttgacacttcaggtgggtatgatgtgtcccactgtgagtgtaatttatgcaacaagctctcgtgctaacaaacacttgggttattttatgcatctactc

SEQ ID NO: 452297 - DNA, 807 bp, Homo sapiens
  misc_feature (3)..(3): n is a, c, g, or t
ggnccgctctagaggatccccacgttgacacttcaggatctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaaac

SEQ ID NO: 452298 - DNA, 365 bp, Homo sapiens
gggaggggcatttggtcctcaggctgagcccacctggattccccaggcccttggtgagcgccactctggctgcaactccccttgcctggcccgtcctgaggcccctctctcgtcctcagtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcgga

SEQ ID NO: 452299 - DNA, 742 bp, Homo sapiens
aatgggtgcttccttagggtgtcatttagttttttggggacttttaacccaagacttttttaggggtagggttaagtatttgggccttcctccttaaaaaggtatttctcccttttatggttgaggcacaggtccttttacaagggaattcggttttaaaaccgttcaacgtttgagcccattttcggtaaaattgttttatttttaaaggatgttcacatatttggcccttttgttataaaattgggttgatttataaagaattttaccggtatttttccaataggttaaggctttaaatttttcaattcgcatttaaggggggtttctttttgatatgaccgtttgaatgggcctttttgctttttagcctgcgcaccaaatgggaatttcgttcaaagcggttttatttggtaataccccagtttttcaaattgggatgtttttaaaagccgttcagttggtttttaacagggtttttttaaggccaatttgtgtaaagggcccccccggagtttttttattttattttttatatgttttttttttgttttttgtttcttcctttattttttttttttttttttttttttttttttttttttttttttttttttttttttttttttttttaagtataaacaaaagttttttattagcattctgaaagaaggaaagtaaaatgtacaagtttaataaaaaggggccttcccctttagaataaatttcagcatgtgctttc

SEQ ID NO: 452300 - DNA, 1949 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452301 - DNA, 2133 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactgagtgcccgtgaactttcgccaaacca

SEQ ID NO: 452302 - DNA, 2003 bp, Homo sapiens
  misc_feature (1906)..(1906): n is a, c, g, or t
  misc_feature (1913)..(1913): n is a, c, g, or t
  misc_feature (1939)..(1939): n is a, c, g, or t
  misc_feature (1946)..(1946): n is a, c, g, or t
  misc_feature (1954)..(1954): n is a, c, g, or t
  misc_feature (1956)..(1956): n is a, c, g, or t
  misc_feature (1960)..(1960): n is a, c, g, or t
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaatgtcagttataaaagggnctccttnataaaaaaaaaaaactcgggcctttnggggggnaaaggttnanggcnggcatgtccgccgcttgaaaggggaaccgcccaagggggaata

SEQ ID NO: 452303 - DNA, 1566 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcgga

SEQ ID NO: 452304 - DNA, 1662 bp, Homo sapiens
tccctgccagctcatccgtcctcgactctttgtgcttgctccaagctctgtagccaatccccccttttaacttagaaaccaaacgactaaactctctgtaggggatcctgctgctgtgcttgcctgcctcgctacttcctaaaaagcaacaagtaagtttttgtgtatgctgcaagattgttgcattgtgtatactgagataatctgaggcattggagagcagattcagggtgtgtgtgtgtgtggcacacgccgagtatccatatctgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452305 - DNA, 1970 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaaggtaaaactccaaagaggccagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452306 - DNA, 2001 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtaaggtgtactaggggggggcctgtgaacgcgaaagacacgccaacgtaacttctaccccttgaacaccaaaggggacgggacaggtgggcccgtcaaacgcgaacattggtttgccaacttggtcacaggaggagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452307 - DNA, 1889 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452308 - DNA, 1784 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataactccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452309 - DNA, 1370 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgcagagggaatctccctggccttggccaaggggggccggggggcggcccgcggggggacccctcggggcgcccaggggacagaaccggg

SEQ ID NO: 452310 - DNA, 1495 bp, Homo sapiens
  misc_feature (1494)..(1495): n is a, c, g, or t
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgaccggcaacgcagtcactgggacatggccgggcagtcctttcccagcgggtacttgacgtgggcaaggagctccgggaaaactcacataaggaggggccggggcgaaaacagacgcgtataaggtggatgtccgggttcgcacgaagaaatgcccggcgcgtggccaaaggggggcatgtagggagacacgaaggtgtgaaccacacggggcccggacacctacagcggggcggaacacacagccgtgccagtcgcgcaaacgacggcagaaactagcgctcccacaccagagagcgagagacacacagccagccctctacgcgcggcagcgagcgctactccagtagcagagagtgtgtcgttcacnn

SEQ ID NO: 452311 - DNA, 1291 bp, Homo sapiens
  misc_feature (1119)..(1119): n is a, c, g, or t
  misc_feature (1181)..(1181): n is a, c, g, or t
  misc_feature (1190)..(1190): n is a, c, g, or t
  misc_feature (1204)..(1204): n is a, c, g, or t
  misc_feature (1248)..(1248): n is a, c, g, or t
  misc_feature (1271)..(1271): n is a, c, g, or t
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagatgccacagccatgcgctaccacagagcagagcacaaagaattgggctataccttctacaggtgcagtgcagaagtgcagaaatagagaagacaaaaggcaaagtgaggttccnagatatagacagccccgtgcaatccaaggcaccacaagtcgtgatccggtctgtgcctacanattgtcccnctctttgggtcccnctcttggacattaggaacagaggaagtatagagggctctcccanggctacaccggtgaatgtgggangaggaagaccctattacctt

SEQ ID NO: 452312 - DNA, 1101 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtccttggctggctcggatcctggaggaaccggcgaggcattccgacggacttttctttgcccttgggttgtcggaaagggttggatgggcagcatgcctgggcctccattgcctatggttggtgggtaacaataggttcatctttgacctgggaattccattggccccaaggaattaggttaaaggggatgggtaattaggagggagggagctttgggttggaagctggtgtggaaaaaaaaccaatggtgcgaaaacgttaaaaattttaaaaccctttgaaatcccaaaagggggacg

SEQ ID NO: 452313 - DNA, 341 bp, Homo sapiens
ccaccgctgggtccccagcattaagccctggagcatgagcccagtgaactttgaaattcaggaaggaattcacaggaaagctgcggcgaggcgggcagaaaaccacaggcttccaagaaacgcgtgtctgccgccccctcctcccaccctgaggccagtcctagagcgaaggccctcctccgacgtcgtcaccaagcccaagggaagggtggcaggtgctcagcgggcagacgccccgccccgccccgccaggttctgttgggggcgaggcccgcgcaagccccgcctcttccccggcaccaggggcgggcccaggtgcgcccagggccggggagcggccg

SEQ ID NO: 452314 - DNA, 159 bp, Homo sapiens
agccgctgcactggtcttgggtgtaatttacaggcttctttaccagagagatgtttctccgtctgctggagccgcaagcctcctcaggcactttctggcttgcttcccctccttgcgggccctactaatttgtattccctgggctgtcttactcctaga

SEQ ID NO: 452315 - DNA, 994 bp, Homo sapiens
aaaattaggctaggtacgaggcttgggtgtaatcggccgaggcgagcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgcagagggaatctccctggccttggccaaggggggccggggggcggcccgcggggggacccctcggggcgcccaggggacagaaccggg

SEQ ID NO: 452316 - DNA, 1573 bp, Homo sapiens
aaaattaggctaggtacgaggcttgggtgtaatcggccgaggcgagcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452317 - DNA, 2615 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttcaaaaaaaaaaaaaaaaaagaaaaaaagcggggtttttgtttttggaccccttttatagggggaaaaaaatttgggggttggggaaacttttgggcgggggtttttaaggcacacattatttataggccgcgaaaaaaattcagccaggacatctcgtgggttctcgatccccgaatacaagcattgcgggggggaccctcctgggacatattttttgactcttagaacaataaccctcaagcccttcttgtgggggcatcgcctaaaacctattgggggctgcaccctccccattttcatgaaaaaagcctttcataggattaagaatcccgggggatttatgtagaccccttcgaaaggatgtcctcgcaagacaaacctgtgttctcaacaatgatcctttaaatcatcagtcacaaggggttttgtggcaccgttacgactttatgtatctcaaactttgtccctatctttcaacagttggtgcccagggagattcaacgagggggggattaaacaccttccaaaaaagggattcgcgccagcaattttcattgtggtgaggcttcggacgggagacaatataagtgtccccaatcgcagagccgatgtttacgcgcgtctctcggatatgaggatggtccctggcccaagtgttagcgtcaa

SEQ ID NO: 452318 - DNA, 1735 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatgtccccgtacatcgttagaagcttgaattcgagcagtagtagtagtaggcggccgc

SEQ ID NO: 452319 - DNA, 1968 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgctgtgtgttctcttccaggccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452320 - DNA, 1778 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452321 - DNA, 2438 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaagggtaagtggccccttaccctcctcctgccatcagcctgcctcctcccttccttgactgagctcagccctgcccagctgtggtttacattatccttcactgtgaacatcatcttggcagaaagtcatgtttctgcgtgagaatggcgaggtggtggtttgtcccaccgttcagtgtacacagttggggctggagtgagtcagtcacaaggcaggccctgcccaggcggcgtgggtgactggggatgaggtcttcctgttgagcatttgaggactgctgcacacgggcctgaggctggcctgaggtgtggagggagcgctgctatgtggggcataagagttggtcacgggtgacaggacggaggaccacgggccagggtgtttcccaacacagtctggtctgagcgggaggccaggcctctggcctgtgtttctgagcttgagttgcaggtgataatgttggcacaaaagacctgccatgccagtctggcctctttctccacctgtttcccggtgaaggagccaggacctggcctgcgagtctgtcctgttctagcagtgaagcctggtttgccaggcacggggctgggaagcaagcagtctgggtctggagggtggccccaaaaaggccaactctgcagctccacagccacatgggggaggctgccacaggtcacactccttagccggatcccctcctgaagaaaagcatctgagctgaccagcgagactgcagtggggcagacactattaaatttgctggcacagctctgagtaccccctcgcttccaccctgacttcatcccgcagtagctctcagccctcccagcccctgcagggccacgtctttctctattgccggtcagcgtgtgtgtgcacaaagcccctaaggtttcatgtgtacacaccggtgctaagtgttttttacacccttgtgcatctctcggcctggggctcctgtgcaggttgccctgagagttgggtttttagttcaaaaagaaggaacacagatgactactctgctggcgacacggccactctgctggcacgcacatagcatggcgcctcctttttttgggggactcttccttggtggcatctctggcaggctgtgtcctctcc

SEQ ID NO: 452322 - DNA, 1316 bp, Homo sapiens
aaaattaggctaggtacgaggcttgggtgtaatcggccgaggcgagtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaaggtaaaactccaaagaggccagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452323 - DNA, 748 bp, Homo sapiens
gggaggggcatttggtcctcaggctgagcccacctggattccccaggcccttggtgagcgccactctggctgcaactccccttgcctggcccgtcctgaggcccctctctcgtcctcagtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452324 - DNA, 1317 bp, Homo sapiens
ccatcctcccaacaggagccacctgagcttgggccagacatgaccatcttgtgtgacccagaaacggtattttatgaatctccacacttgaccctggacgttctaccctgtgtccgatttcagatcgaaccccgcccttcagaggacaccttaatcataaaccaggcattgaggcgatgggaagcgtagaccccaaacatcactccagcaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagtgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 452325 - DNA, 446 bp, Homo sapiens
accagcaacacatagaggaaactgatgttccaaatgtttctggtgtttcagtgtatgtgtcttctagaaagtaggagattttatttttaaaacctatctatgtttaaaccctattttgaaagaaaatttcattttccttgcctacaaatctgaaagctgtacatcctaagtaaaaatctatgcccaaagtgctgggattacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgatagttg

SEQ ID NO: 452326 - DNA, 4924 bp, Homo sapiens
aacttctcgggaagatgaggcagtttggcatctgtggccgagttgctgttgccgggtgatagttggagcggagacttagcataatggcagaacctgtttctccactgaagcactttgtgctggctaagaaggcgattactgcagtctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaaaaaaaattgattgaaactcagatggaatggaaatgtacaaaaatgacaccattctaggaatttgctagacaaaatgtaggactaccagatcagtatctcctagacacttgttagaaatgcacaatcccggggaacgcagtacatttggccacatgtagtttatgtttccttttcatgggagggataaaatttaaagctttttttttctttgaatacagtccttccttttctatgccttttaaggcttctagatgctattcagcctttttacagcaggtgcaactctatttttcaaggtatcttagaagataacactaggccattgaagcctttcaaaaatatatttttatgcaaattgacacgagtgcagtatactaatgcaaattaattttggtgtttagcttttattgctcatttataacccaagaaatggtacagaccacagtaagtgggattaggtaacaactacaacatggaaaaacagtgtctaagatcacgtactgctaatttaggttacaaaactcaaggctgtaacctttatatgaaagtacttaagcttgaaagttcataatagtttggtatcacctcattagtatagtacagtggttctcaaagtttggtcctgggtcatcgacattacttctttttctttctgagacagggtctcagtctgtcacccaggatggagtgcagtggcgtgatcatggctcactgcagcctcaacctctcgggttcaggtgatcctcccacatcagcctcctgggtggctgggactacaggcacacgccaccatgcctggctagtttttgtaaagacgaggtttccccatgttgtgcaggctggtcttgaactcacagactcaagtgatccttttacctcagcctcccaaactgttgggataacaggtgtaagccaccacacacagctataatcaaccttcaaacttataaaaagtgtggatccttgggtctgaacccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgatagttg

SEQ ID NO: 452327 - DNA, 3213 bp, Homo sapiens
aacttctcgggaagatgaggcagtttggcatctgtggccgagttgctgttgccgggtgatagttggagcggagacttagcataatggcagaacctgtttctccactgaagcactttgtgctggctaagaaggcgattactgcagtctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttacctta

SEQ ID NO: 452328 - DNA, 4641 bp, Homo sapiens
aacaaagtatagcacaaagaagatgtgatttgaggattgtataatcataatgtcctgggaacttcttaagtaaaagatcttcttaaatggatctcaggtctttattttcctgtatcagccagagttgaacaaacttttgtttaaaaaaagagccagatagtaaatattctaggctttatgggccataaagtctcttggagctactcatttctacagttttagagcaaaagcagccatagatagataataggtaaatgaatgggtgtggctgtgtttcaagaaaactttaacaaaagctggcagctggctagatttggcttgtaaggtgctatatgctgacccctgcttattaactaaagtcagtattgcattctgttttgcctgttcatatctatgaagacttagaattcttattcatcctttctgggattcaggtgccacatgggcagagaaacgtggtttctatcaaatcatctatatttttttttccttgagtcatgctaatagatggttcaatacatgaatgagtcccttgctgaaatgctttaggacttcagactaccctgaacgttgattactctttatactgaaataggcattattcagtggaagagagggaagaccaaattgatagactggactttattcgaaaccagatgaaccttttaacactggatgttaagaaaaaaatcaaggaggttaccgaggaggtggcaaacaaagtgggtaacagtagcttcatgattaaaataacctggatggaaattatttttgataatgctaaaaatgttattcctgttactttaaaagaatgttttcagatttttcaatttaatttttttgaataattgataatcttgtttaattattttaactccaaaattttcatattttcaggtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaaaaaaaattgattgaaactcagatggaatggaaatgtacaaaaatgacaccattctaggaatttgctagacaaaatgtaggactaccagatcagtatctcctagacacttgttagaaatgcacaatcccggggaacgcagtacatttggccacatgtagtttatgtttccttttcatgggagggataaaatttaaagctttttttttctttgaatacagtccttccttttctatgccttttaaggcttctagatgctattcagcctttttacagcaggtgcaactctatttttcaaggtatcttagaagataacactaggccattgaagcctttcaaaaatatatttttatgcaaattgacacgagtgcagtatactaatgcaaattaattttggtgtttagcttttattgctcatttataacccaagaaatggtacagaccacagtaagtgggattaggtaacaactacaacatggaaaaacagtgtctaagatcacgtactgctaatttaggttacaaaactcaaggctgtaacctttatatgaaagtacttaagcttgaaagttcataatagtttggtatcacctcattagtatagtacagtggttctcaaagtttggtcctgggtcatcgacattacttctttttctttctgagacagggtctcagtctgtcacccaggatggagtgcagtggcgtgatcatggctcactgcagcctcaacctctcgggttcaggtgatcctcccacatcagcctcctgggtggctgggactacaggcacacgccaccatgcctggctagtttttgtaaagacgaggtttccccatgttgtgcaggctggtcttgaactcacagactcaagtgatccttttacctcagcctcccaaactgttgggataacaggtgtaagccaccacacacagctataatcaaccttcaaacttataaaaagtgtggatccttgggtctgaacccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgatagttg

SEQ ID NO: 452329 - DNA, 2746 bp, Homo sapiens
aacttctcgggaagatgaggcagtttggcatctgtggccgagttgctgttgccgggtgatagttggagcggagacttagcataatggcagaacctgtttctccactgaagcactttgtgctggctaagaaggcgattactgcagtctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccacc

SEQ ID NO: 452330 - DNA, 4980 bp, Homo sapiens
aacttctcgggaagatgaggcagtttggcatctgtggccgagttgctgttgccgggtgatagttggagcggagacttagcataatggcagaacctgtttctccactgaagcactttgtgctggctaagaaggcgattactgcagtctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaaaaaaaattgattgaaactcagatggaatggaaatgtacaaaaatgacaccattctaggaatttgctagacaaaatgtaggactaccagatcagtatctcctagacacttgttagaaatgcacaatcccggggaacgcagtacatttggccacatgtagtttatgtttccttttcatgggagggataaaatttaaagctttttttttctttgaatacagtccttccttttctatgccttttaaggcttctagatgctattcagcctttttacagcaggtgcaactctatttttcaaggtatcttagaagataacactaggccattgaagcctttcaaaaatatatttttatgcaaattgacacgagtgcagtatactaatgcaaattaattttggtgtttagcttttattgctcatttataacccaagaaatggtacagaccacagtaagtgggattaggtaacaactacaacatggaaaaacagtgtctaagatcacgtactgctaatttaggttacaaaactcaaggctgtaacctttatatgaaagtacttaagcttgaaagttcataatagtttggtatcacctcattagtatagtacagtggttctcaaagtttggtcctgggtcatcgacattacttctttttctttctgagacagggtctcagtctgtcacccaggatggagtgcagtggcgtgatcatggctcactgcagcctcaacctctcgggttcaggtgatcctcccacatcagcctcctgggtggctgggactacaggcacacgccaccatgcctggctagtttttgtaaagacgaggtttccccatgttgtgcaggctggtcttgaactcacagactcaagtgatccttttacctcagcctcccaaactgttgggataacaggtgtaagccaccacacacagctataatcaaccttcaaacttataaaaagtgtggatccttgggtctgaacccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgatagttg

SEQ ID NO: 452331 - DNA, 1557 bp, Homo sapiens
aacttctcgggaagatgaggcagtttggcatctgtggccgagttgctgttgccgggtgatagttggagcggagacttagcataatggcagaacctgtttctccactgaagcactttgtgctggctaagaaggcgattactgcagtctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggtatgagttcattttgttgcaacataaaaatgttagtttttttgtcagacttttgttaagatgaggttttaaattgttgtactataaatactttttacactgaaatcaaccttgtgggtttaactgatgcctacttctatatttttaagtgcgtatttgaaagtgtcgatatttattctgcaaccttgcacacatcatttatatcccctggacctcactattcctgtgtatgaattgtgatttttaaaatgttttgtggctttaaaatatctttgaagcagtggaagaaccatttcttcaagcagatttttatgaagaagtccaaaacaggtgatcctctttctgcattcaacccacgacccattttttaatatggt

SEQ ID NO: 452332 - DNA, 174 bp, Homo sapiens
gaaatttggctgatcgatgcaccgatgaagtaaacgccttagtgcttcagacccagcaagaaattattggtaatatttatgtctacaaggtcatgtctggtttgttttttcattcatgactggtgaagagcttattttcctttaggcattccattgaaggtaaaacatttacca

SEQ ID NO: 452333 - DNA, 723 bp, Homo sapiens
gtatacagtatttacttctatttataggatctgtaaaatagtatgaaaatttgcaggttaaaagtagtgaattaaatatcacaagtttcatcttaaatttttaaaaaacatacatctttaggaatgaactatcaccacctagctggtctttaatacttcctaagcattttcacatcacagcacacaaagaaatatttgtacgttgaggtaataagaaaaccccaggtgccctatctagccttctctgaatatcaaggggatctgtcttaagtattaaatgttatttttagtagtagttcttatttgtttctttaaaaaatgtatatcattaacagcatggatatgcttgttttggtttttgaaaggtctgacctacaatatttaacattgttttatttttgagatacattgaatcaggataagtctggcagcttataaagctctccctcatttgtgtgctgatcccttttaagcctgattgatttctggtaacttcaggttttctcatggagaaggaatatacatttttagaaaatgtatctaactcaaagatccatagggaactaaaatgcttttaaatgtactctccaaagtggtgtttttccttctcagactaagctatgactttatcttacagatttggaaaactataggctggaaactcctatctgtttcattaactatgtatggagctttgtatctttatgaaagactgagctggac

SEQ ID NO: 452334 - DNA, 606 bp, Homo sapiens
caagaaaactttaacaaaagctggcagctggctagatttggcttgtaaggtgctatatgctgacccctgcttattaactaaagtcagtattgcattctgttttgcctgttcatatctatgaagacttagaattcttattcatcctttctgggattcaggtgccacatgggcagagaaacgtggtttctatcaaatcatctatataaaatactttataagtgaaatattacttgaatcctttgagatgttacaagttttttttttccttgagtcatgctaatagatggttcaatacatgaatgagtcccttgctgaaatgctttaggacttcagactaccctgaacgttgattactctttatactgaaataggcattattcagtggaagagagggaagaccaaattgatagactggactttattcgaaaccagatgaaccttttaacactggatgttaagaaaaaaatcaaggaggttaccgaggaggtggcaaacaaagtgggtaacagtagcttcatgattaaaataacctggatggaaattatttttgataatgctaaaaatgttattcctgttactttaaaagaatgttttcagatttttcaa

SEQ ID NO: 452335 - DNA, 387 bp, Homo sapiens
acaaatagctaccacttttgctcgcctgtgccaacaagttgatattactcaaaaacagctggaagaagaaattgctagattacccaaagaaatagatcagttggagaaaatacaaaacaattcaaagctcttaagtttaaacctttcttctcaataatttgaacatttactggtctcattacaaaatatgtaaaattattaatgaatttgtattcattcctaatagctttttgtgttggtttaaatgaaaatcttccatatttaattccatgtggtttgcagtttcaccgaaggtttaaatgaaaatcttccatatttaattccatgtggtttgcagtttcactgaaggctaattgcaacaagaaaacaaatctgaattgaaaggga

SEQ ID NO: 452336 - DNA, 5051 bp, Homo sapiens
aacttctcgggaagatgaggcagtttggcatctgtggccgagttgctgttgccgggtgatagttggagcggagacttagcataatggcagaacctgtttctccactgaagcactttgtgctggctaagaaggcgattactgcagtctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaaaaaaaattgattgaaactcagatggaatggaaatgtacaaaaatgacaccattctaggaatttgctagacaaaatgtaggactaccagatcagtatctcctagacacttgttagaaatgcacaatcccggggaacgcagtacatttggccacatgtagtttatgtttccttttcatgggagggataaaatttaaagctttttttttctttgaatacagtccttccttttctatgccttttaaggcttctagatgctattcagcctttttacagcaggtgcaactctatttttcaaggtatcttagaagataacactaggccattgaagcctttcaaaaatatatttttatgcaaattgacacgagtgcagtatactaatgcaaattaattttggtgtttagcttttattgctcatttataacccaagaaatggtacagaccacagtaagtgggattaggtaacaactacaacatggaaaaacagtgtctaagatcacgtactgctaatttaggttacaaaactcaaggctgtaacctttatatgaaagtacttaagcttgaaagttcataatagtttggtatcacctcattagtatagtacagtggttctcaaagtttggtcctgggtcatcgacattacttctttttctttctgagacagggtctcagtctgtcacccaggatggagtgcagtggcgtgatcatggctcactgcagcctcaacctctcgggttcaggtgatcctcccacatcagcctcctgggtggctgggactacaggcacacgccaccatgcctggctagtttttgtaaagacgaggtttccccatgttgtgcaggctggtcttgaactcacagactcaagtgatccttttacctcagcctcccaaactgttgggataacaggtgtaagccaccacacacagctataatcaaccttcaaacttataaaaagtgtggatccttgggtctgaacccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgatagttg

SEQ ID NO: 452337 - DNA, 4466 bp, Homo sapiens
aacaaagtatagcacaaagaagatgtgatttgaggattgtataatcataatgtcctgggaacttcttaagtaaaagatcttcttaaatggatctcaggtctttattttcctgtatcagccagagttgaacaaacttttgtttaaaaaaagagccagatagtaaatattctaggctttatgggccataaagtctcttggagctactcatttctacagttttagagcaaaagcagccatagatagataataggtaaatgaatgggtgtggctgtgtttcaagaaaactttaacaaaagctggcagctggctagatttggcttgtaaggtgctatatgctgacccctgcttattaactaaagtcagtattgcattctgttttgcctgttcatatctatgaagacttagaattcttattcatcctttctgggattcaggtgccacatgggcagagaaacgtggtttctatcaaatcatctatatttttttttccttgagtcatgctaatagatggttcaatacatgaatgagtcccttgctgaaatgctttaggacttcagactaccctgaacgttgattactctttatactgaaataggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgttttaaaaaagctgttgttcttcaggaggcatttgcctaggatattgctggattataccccattggaggcttttaattttatttgtatgaattttccaggatttcattaaaaattattattgtattttttaccttaatgaaagattttgggttcaaatatctttctatattaaaagctgattgagtctgtacatatgtaaattatgcctagtggaggttctgttgactttcttccccactgtggaagaggccagttttgcctccatttgcacattcatttcagttatttctgatccataaatataacatttacaaaattcttccttgagctggtggaaatgcctcaccagtttcctctttaatgaatcaaataaaatctttaactgatgttaaaaaaaattgattgaaactcagatggaatggaaatgtacaaaaatgacaccattctaggaatttgctagacaaaatgtaggactaccagatcagtatctcctagacacttgttagaaatgcacaatcccggggaacgcagtacatttggccacatgtagtttatgtttccttttcatgggagggataaaatttaaagctttttttttctttgaatacagtccttccttttctatgccttttaaggcttctagatgctattcagcctttttacagcaggtgcaactctatttttcaaggtatcttagaagataacactaggccattgaagcctttcaaaaatatatttttatgcaaattgacacgagtgcagtatactaatgcaaattaattttggtgtttagcttttattgctcatttataacccaagaaatggtacagaccacagtaagtgggattaggtaacaactacaacatggaaaaacagtgtctaagatcacgtactgctaatttaggttacaaaactcaaggctgtaacctttatatgaaagtacttaagcttgaaagttcataatagtttggtatcacctcattagtatagtacagtggttctcaaagtttggtcctgggtcatcgacattacttctttttctttctgagacagggtctcagtctgtcacccaggatggagtgcagtggcgtgatcatggctcactgcagcctcaacctctcgggttcaggtgatcctcccacatcagcctcctgggtggctgggactacaggcacacgccaccatgcctggctagtttttgtaaagacgaggtttccccatgttgtgcaggctggtcttgaactcacagactcaagtgatccttttacctcagcctcccaaactgttgggataacaggtgtaagccaccacacacagctataatcaaccttcaaacttataaaaagtgtggatccttgggtctgaacccagacctatggagtcagacagtaggtttgaggcccagcaatctatggtttaacaagccatccaggtgtttctgatgcacagtgaaattggggtaccactggtattaggtttggtatggcaactttttcatcacttgttttatgtagttgtctgatcaattgtgaaaacataatgaatgttggaaatggaacagtaaaataacgaaagccaactttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgtgagccaccgcgcccggccgaaagccaactcttatgcctagaaatatgtgcacctatgaccaagcccatgaattatacaggaattatgtaattatgagtgatgtacttcaaagttattgcacatacacttgtttactttgtatgtttgcaggattaaactttgtataatctttttacaaaaattttttttcagtatgcaagcttgcaagatgaaaataaaacctgtttgcctgatagttg

SEQ ID NO: 452338 - DNA, 3129 bp, Homo sapiens
aacttctcgggaagatgaggcagtttggcatctgtggccgagttgctgttgccgggtgatagttggagcggagacttagcataatggcagaacctgtttctccactgaagcactttgtgctggctaagaaggcgattactgcagtctttgaccagttactggagtttgttactgaaggatcacattttgttgaagcaacatataagaatccggaacttgatcgaatagccactgaagatgatctggtagaaatgcaaggatataaagacaagctttccatcattggtgaggtgctatctcggagacacatgaaggtggcattttttggcaggacaagcagtgggaagagctctgttatcaatgcaatgttgtgggataaagttctccctagtgggattggccatataaccaattgcttcctaagtgttgaaggaactgatggagataaagcctatcttatgacagaaggatcagatgaaaaaaagagtgtgaagacagttaatcaactggcccatgcccttcacatggacaaagatttgaaagctggctgtcttgtacgtgtgttttggccaaaagcaaaatgtgccctcttgagagatgacctggtgttagtagacagtccaggcacagatgtcactacagagctggatagctggattgataagttttgcctagatgctgatgtctttgttttggtcgcaaactctgaatcaacactaatgaatacggaaaaacacttttttcacaaggtgaatgagcggctttccaagcctaatattttcattctcaataatcgttgggatgcctctgcatcagagccagaatatatggaagacgtacgcagacagcacatggaaagatgcctgcatttcttggtggaggagctcaaagttgtaaatgctttagaagcacagaatcgtatcttctttgtttcagcaaaggaagttcttagtgctagaaagcaaaaagcacaggggatgccagaaagtggtgtggcacttgctgaaggatttcatgcaagattacaggaatttcagaattttgaacaaatctttgaggagtgtatctcgcagtcagcagtgaaaacaaagttcgaacagcacactatcagagctaaacagatactagctactgtgaaaaacataatggattcagtaaacctggcagctgaagataaaaggcattattcagtggaagagagggaagaccaaattgatagactggactttattcgaaaccagatgaaccttttaacactggatgttaagaaaaaaatcaaggaggttaccgaggaggtggcaaacaaagtttcatgtgcaatgacagatgaaatttgtcgactgtctgttttggttgatgaattttgttcagagtttcatcctaatccagatgtattaaaaatatataaaagtgaattaaataagcacatagaggatggtatgggaagaaatttggctgatcgatgcaccgatgaagtaaacgccttagtgcttcagacccagcaagaaattattgaaaatttgaagccattacttccagctggtatacaggataaactacatacactgatcccttgcaagaaatttgatctcagttataatctaaattaccacaagttatgttcagattttcaagaggatattgtatttcgtttttccctgggctggtcttcccttgtacatcgatttttgggccctagaaatgctcaaagggtgctcctaggattatcagagcctatctttcagctccctagatctttagcttctactcccactgctcctaccactccagcaacgccagataatgcatcacaggaagaactcatgattacattagtaacaggattggcgtccgttacatctagaacttctatgggcatcattattgttggaggagtgatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacaacaaatagctaccacttttgctcgcctgtgccaacaagttgatattactcaaaaacagctggaagaagaaattgctagattacccaaagaaatagatcagttggagaaaatacaaaacaattcaaagctcttaagaaataaagctgttcaacttgaaaatgagctggagaattttactaagcagtttctaccttcaagcaatgaagaatcctaacaatagagattgctttggtgaccatgataggaggaaacgaaacttgtaagattggaacagttgttatttttatgaaattactttaaatatgaattgtactaactgtacctaaatagcaaagccctgtgtagattctggtaatgatctgtctcagggtatgtgtatttttgaagagtgttatgtccttagttttaattttgagtaaagaaaaggctaaaatcatgaattagttacaagcaacagtaccaacttatgtgacccctgaggggtggggctgtgagctcttaatttgtttttgattctgaaaaactctgcttcctggcatccaggagttagagattgagcctttcatcttctttctcaaaactagtttttgatgctttctttcatgggaatagtcacttttttatttagtaaatcgcattgctggaaccaccaaggagtgtggaatgtccttgagtgtattatttatgcaagtcacagtcacgttgccatcatggcagctatgtgaaacactaataaatgtgtttttactttttattcccgttaaaactgatgtaaaacaggataaaggcttgttatagtcacttataagtatctgggtctaagtaatttccttagatgtttctaaagaaacattttcagctttgctcccattatgattccaataaggaacgctttcctagtgcaattttaggagtaaagtttgaagagataaaaatagccaaagataggagacgtctgaattttgaatgataaacagtgatgcggcaagccatgctgccggcatctgaccacgaatgattagtacagatatatt

SEQ ID NO: 452339 - DNA, 733 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgac

SEQ ID NO: 452340 - DNA, 410 bp, Homo sapiens
ttagacagagtttcacgtttgttgcccaggctggagtgcaatggcaccatctcggctcactgcaacctccgcctccagtcaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452341 - DNA, 672 bp, Homo sapiens
ttttgtatttttagtagagatggggtttcaccgtgttagccaggatagtctcaatctcctgaccatctgtttgttggtaccactctgtttatttctgtatgtaattcaaggtggaaatttgccaatacgtagttatttgcacaatttaactcagcaggattattacacagctacagctatttctttatttatatttttggaaaagggatagaatcttcactttgttgtatcttcactttgtttctctttggaccctacccgtgagacactaataaattataatccatgttactgcttattctttccgtgtaaagtacttttcaagttgatcataagctgagcaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452342 - DNA, 708 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagaaaagcaacaaaatatttctcccctagtgagagaaagaggtcctcagagagtagcagctcacataactgggaccagaggaagaagcaacacattgtcttctccaaactccaaaaaaaaaaaaaaaaaaaaaaaaacctgtgtgtggggcgcgccctgggccctgggaaaaagttttttaaaaccccaatgtggttgtggggcgcgcgggggcccccagtggggttaggggacccggggcccaaaaacgggtcgccagaagaagagactccggcgccaaaagacaataggggcggggggagtcccctcccccatattaaaaaagccgcgcggggggaacccccggagcgcggttcggagaaccaaatccccaaaggggaggtccgaaggggcccatagcggggctctcttcacgggggaggcccaagggaggagccggatttttaaaataagg

SEQ ID NO: 452343 - DNA, 1606 bp, Homo sapiens
  misc_feature (1504)..(1504): n is a, c, g, or t
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagggagccacggcacccagcctttctctcttaggattacttcttccatccctcggcacttctctgcttggntcgccatcaaatctcccttctctttaagggttctaaatcatttactatccctatgaatcactaggtgctcctagggccatttacattaaattaaaccacagg

SEQ ID NO: 452344 - DNA, 1910 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452345 - DNA, 2021 bp, Homo sapiens
ttttgtatttttagtagagatggggtttcaccgtgttagccaggatagtctcaatctcctgaccatctgtttgttggtaccactctgtttatttctgtatgtaattcaaggtggaaatttgccaatacgtagttatttgcacaatttaactcagcaggattattacacagctacagctatttctttatttatatttttggaaaagggatagaatcttcactttgttgtatcttcactttgtttctctttggaccctacccgtgagacactaataaattataatccatgttactgcttattctttccgtgtaaagtacttttcaagttgatcataagctgaggtaggttgatcataatatcaaaatgttatttttatgaaaactcatagaatcaactttggaagcccagtatgcttacaatggctgattgacaacacctatgaagagcaaggtattggagaactagtttggcaagtgttgatgaccctttatcatttctcttttagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452346 - DNA, 1805 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452347 - DNA, 1074 bp, Homo sapiens
ctttatatagattatattcagggaaggcataacgattctaaacaacgacgctgtattctaaattcctgtactgttacaaagatccctatagtaggcgctcaacaactgtcgacgctttcacatttacccagccgccagagagggcttgtcttgagtgtgtctgaggatgcagcacccaaagggaaaaaccactacatgagattgcggtgtttcaaacaccgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452348 - DNA, 873 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaacaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452349 - DNA, 1405 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaaggtaggtaacctcaccaggtgacctcaccagcaggcggagaaggccagaagaattccttaaagcaaaggaatctttaagataatcaagtctagactcttcattttacaaataagaaaacttaggcccagagtatttaagtaattttccccaaattcatagaactaggaaaatggggcatagcagcaaagggcaggacctggccgactcctggtctagagttcattcctctgccccggacagcctccacatctagtctaaccttttgatctcacattatggaaactgaggcacacacagggtaatgaagagaaggtcacaaagtcataaagaatgtgtggcattgtttttcattcaaaagataaagaagatcaaataatgatattttatattcttcccacattgctgatgtctggaattaaatatttatttttgtatgcatatagagataaagaaagaggaaaataagaggaaagaaagaggaaaggaagggaagggaagaaagagatactttgagaaattgaaggtggttttttcttaatttacagccaataaataacaaattacaaaaagtatctgtttatggaagttgcttaaacaggacctccagcagagacatgttagttaacagtttattttactaaatgtggcagagtgacagatctaatcaagtttcttctcttaggctcttccttctttataagatggcattaaataatatttgcagccgggtgtagtggctcacgcctgtaatcccagcactttgggaggctgaggcaggcggatcacctgaggtcaggagttgaagaccagcctggccaacatggtgaaaccctgtgtctactaaaaatacaaaaattagcaaagtgtggtggtgtgtgcctgtactcccagctacttgggaggctgagacaggagaactgcttgaacctaagaggcagaagttgcagtgagctgagatcatgccactgcactctagcctgggcaacagagcaagactctatctcaaaaacc

SEQ ID NO: 452350 - DNA, 1083 bp, Homo sapiens
cgactactactactaaattcgcggccgcgtcgatggcaagtcaagtggcaactccgtcagctcgttagaaaggtaggtaacctcaccaggtgacctcaccagcaggcggagaaggccagaagaattccttaaagcaaaggaatctttaagataatcaagtctagactcttcattttacaaataagaaaacttaggcccagagtatttaagtaattttccccaaattcatagaactaggaaaatggggcatagcagcaaagggcaggacctggccgactcctggtctagagttcattcctctgccccggacagcctccacatctagtctaaccttttgatctcacattatggaaactgaggcacacacagggtaatgaagagaaggtcacaaagtcataaagaatgtgtggcattgtttttcattcaaaagataaagaagatcaaataatgatattttatattcttcccacattgctgatgtctggaattaaatatttatttttgtatgcatatagagataaagaaagaggaaaataagaggaaagaaagaggaaaggaagggaagggaagaaagagatactttgagaaattgaaggtggttttttcttaatttacagccaataaataacaaattacaaaaagtatctgtttatggaagttgcttaaacaggacctccagcagagacatgttagttaacagtttattttactaaatgtggcagagtgacagatctaatcaagtttcttctcttaggctcttccttctttataagatggcattaaataatatttgcagccgggtgtagtggctcacgcctgtaatcccagcactttgggaggctgaggcaggcggatcacctgaggtcaggagttgaagaccagcctggccaacatggtgaaaccctgtgtctactaaaaatacaaaaattagcaaagtgtggtggtgtgtgcctgtactcccagctacttgggaggctgagacaggagaactgcttgaacctaagaggcagaagttgcagtgagctgagatcatgccactgcactctagcctgggcaacagagcaagactctatctcaaaaacc

SEQ ID NO: 452351 - DNA, 1017 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaaggtaggtaacctcaccaggtgacctcaccagcaggcggagaaggccagaagaattccttaaagcaaaggaatctttaagataatcaagtctagactcttcattttacaaataagaaaacttaggcccagagtatttaagtaattttccccaaattcatagaactaggaaaatggggcatagcagcaaagggcaggacctggccgactcctggtctagagttcattcctctgccccggacagcctccacatctagtctaaccttttgatctcacattatggaaactgaggcacacaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452352 - DNA, 546 bp, Homo sapiens
tgtggcataagcagctgacaaggtataaaaagacaagggactcccaacagttcccaatgtcacaatgatgcaggaacctcccaatttctatgtgactagaatttataatccacattaagattgaaggaggaagaagtttgatattagattgaaatccctggcaagcccaacaaaaatataggctggccacagctgcaaaaaagctccttgctttgctacaaattcccttctgttaacgctctttctctctaaatttcctacagactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaaga

SEQ ID NO: 452353 - DNA, 1953 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaggacttctaatctttttttcataatatctttgacacatattacagaagaaataaatttcttacttttaatttaatatg

SEQ ID NO: 452354 - DNA, 1084 bp, Homo sapiens
cacagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagttttttcggggcctttttagttggctaactgaacctcggttaatgaagatgcaaagatcgctttctgtgattattccgtcggccgagatgatacattacatgcatgctgctctgactttagagcataccaccttaccagcga

SEQ ID NO: 452355 - DNA, 785 bp, Homo sapiens
ggacgcgtgggtcgggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaagaaaaaaaataaaaatcataataaattcttattaaatcaaataaa

SEQ ID NO: 452356 - DNA, 686 bp, Homo sapiens
gtgacgcgtgggcgaccacgcgtccggaccacgcgtccgggaggctctgctggggtagggtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 452357 - DNA, 913 bp, Homo sapiens
ggacgcgtgggtcgggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggtccccaaggagcagtatcccctccttctcgtgaacccgagccacatgctgtggcctgggctggggcttggctgacacggacatattctgaactctcagcagaagatgtaagaccagttaattggcagagccggtcctgatttatcagctgccgcacgtgcatgtttcttcgcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 452358 - DNA, 1387 bp, Homo sapiens
ggacgcgtgggtcgggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggtccccaaggagcagtatcccctccttctcgtgaacccgagccacatgctgtggcctgggctggggcttggctgacacggacatattctgaactctcagcagaagatgtaagaccagttaattggcagagccggtcctgatttatcagctgccgcacgtgcatgtttcttcgtacgtgatgttcactttaattgccaggctctgggctgggaggagggggagctttaatgtgagtagagcctgaggcattttggatggacaggttcagcatggtaccagacgtgatttgtgtcatgtttttccatgccttgtttctgccccccaccaaccaggtggccccgtgctagtaaatgggtgcacccagggcgggggcagacaccaggccctaaagagacaatggtggggaaagcggccctgtcctggagctgtggcctctgctgcagcgtgacagccgggggccggtggccgtgggggtgcttacattccaggcagggacgctgccccaggaggcccagggaggtacctctgagcagttgaatccggcgccggcagaaaggggctgccagaaagcatgaggctcccccacagacccctctgctgaggagtctttgcagctctggctggagcctttgttctcccccttaggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 452359 - DNA, 1125 bp, Homo sapiens
tccagattcgggtgccatcctcactcctcctccctcttctcttccctctcctctggtctgctctttctgcctcttagctttggagcacttagtaatcattagcaagttaagatggcttcttgtatttgcttaggtccccaaggagcagtatcccctccttctcgtgaacccgagccacatgctgtggcctgggctggggcttggctgacacggacatattctgaactctcagcagaagatgtaagaccagttaattggcagagccggtcctgatttatcagctgccgcacgtgcatgtttcttcgtacgtgatgttcactttaattgccaggctctgggctgggaggagggggagctttaatgtgagtagagcctgaggcattttggatggacaggttcagcatggtaccagacgtgatttgtgtcatgtttttccatgccttgtttctgccccccaccaaccaggtggccccgtgctagtaaatgggtgcacccagggcgggggcagacaccaggccctaaagagacaatggtggggaaagcggccctgtcctggagctgtggcctctgctgcagcgtgacagccgggggccggtggccgtgggggtgcttacattccaggcagggacgctgccccaggaggcccagggaggtacctctgagcagttgaatccggcgccggcagaaaggggctgccagaaagcatgaggctcccccacagacccctctgctgaggagtctttgcagctctggctggagcctttgttctcccccttaggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 452360 - DNA, 833 bp, Homo sapiens
ggacgcgtgggtcgggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 452361 - DNA, 742 bp, Homo sapiens
ggacgcgtgggtcgggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 452362 - DNA, 649 bp, Homo sapiens
ggacgcgtgggtcgggggcgctgtgccaggcggcggccgtgcggggcgggcgcgctgctccttccgcctcgcggaccccggaagcgcgcgtggccgccatggcgcggaatgtggtgtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagtcccgacacctaaataaaagtcttgctgcaggagaaaga

SEQ ID NO: 452363 - DNA, 652 bp, Homo sapiens
gggtggcggaggagccccccgccaggtaccccctgtaccggctgggtggcccacaacttcgggtgttccgaaccaacttcttcattcagctggtgcggcccggtgtggcccagcccgaggacaccgtgcagttccggatccccatggaaatgacaagggtggacctcaggaattacctcgagggcatctataacgtgcccgtggctgctgtgcggacacgggtgcagcatggctctaacaagagaagagatcacagaaacgtgaggatcaagaagccggactacaaggtcgcctacgtgcagctggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 452364 - DNA, 587 bp, Homo sapiens
tccagattcgggtgccatcctcactcctcctccctcttctcttccctctcctctggtctgctctttctgcctcttagctttggagcacttagtaatcattagcaagttaagatggcttcttgtatttgcttaggtccccaaggagcagtatcccctccttctcgtgaacccgagccacatgctgtggcctgggctggggcttggctgacacggacatattctgaactctcagcagaagatgcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 452365 - DNA, 510 bp, Homo sapiens
ccgcccaccactgttgggagtggacactcagggatccgcagtgttagctacccccttttctgcccaccctgttgtgagtggacactcggaggtctgcagggttggtgtgtcgggctgccttggcctaagtgtgtgacatggacccaatctcttctgtacaggtaccccctgtaccggctgggtggcccacaacttcgggtgttccgaaccaacttcttcattcagctggtgcggcccggtgtggcccagcccgaggacaccgtgcagttccggatccccatggagtgagtccgggaggattccggctggggttggggagcaccctcggggggatccccgtggagtgagcccggaagttttcccgctgggttgggagagtgccctcaggggggcctgggtcctgagttaaaacaactctgctcacgtgctagcctcttcctgctgggaaggcacctcaggcggccctgcccggcaagtattgatggagtccctgtaggtgtggagcccggc

SEQ ID NO: 452366 - DNA, 4042 bp, Homo sapiens
gccacgtgacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggtgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcttgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccatgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactgttgccttcctaaattatgactgctgaatcatcatatctactatatatgactagaagaagtggttcttcaagtcaaccctcttacaggacttagtggaatttgctttatctactttaggccaaatccatcacacattggcttatttgaaacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttttataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattatctttattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggaaaaaaaaaaa

SEQ ID NO: 452367 - DNA, 864 bp, Homo sapiens
gccacgtgacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgccacgaactaatcctcctcggactcctgcctcactcgattgtacaccaaccacccaactatctataaacctagcgcatggccatccccttatgagcgggcgcagtgattataggctttcgctctaagattaaaaagtgccctagcccacttcttaccacaaggcacacctacacgcccttatccccatactagttattatcgaaaccatcagcctactcattcaaccaatagccctggccgtgacgcctaaccgctaacattactgcaggccatctactcatgcacctaattggaagcgccagcctagcagtatcaaccattaaccttccctctacacttatcatcttcacaattctaattctactgactatcctagaaatcgctgtcgccttaatccaagcctacgttttcacacttctagtaagcctctaactgcacgacaacacataatgagccacaatcacatgctatcatatagtaaaaccagccattacccctaacagggccctctcagcctcctaatgacctccggcctagccatgtgatttccattccactccataagctcctcatataggctactaacaaaaaattaacatattaccatgatgggccgatgtaacacgagaaagccataccaaggccacaaaaacactgttcaaaaggcttcgaaaagggataacctattttacctaga

SEQ ID NO: 452368 - DNA, 3056 bp, Homo sapiens
agacagagtctctgtcacccagactggagtgcaatggcacgatctcggctcactgcaaccttcacttcgtgggttcaagtgattcttctgcctcagcctcctgagtagctgggattacagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccatgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactgttgccttcctaaattatgactgctgaatcatcatatctactatatatgactagaagaagtggttcttcaagtcaaccctcttacaggacttagtggaatttgctttatctactttaggccaaatccatcacacattggcttatttgaaactttatcatctttcaccttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttttataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattatctttattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggaaaaaaaaaaa

SEQ ID NO: 452369 - DNA, 2666 bp, Homo sapiens
accagtgagaacaacctgggcagaggcagatgtctcggctcaagttgctggaaacttcttcctcacttttagctaagatctgtcctaggaagtttacagaaaaagcctctgctgctgcttcctgtgccagcagagctcaacttggggatgctagatgactttgccttcgtgctgtgggccaaaatgctaggaagatggagactacctgcttccaatgtttcttgtctttctacgaaagtacctgaggttcctccatgccccgttttgacaagatagctttgaagcaaatgtacacacattaaagcaacaaaaatgtatggactcagtagttacagggagtttcaaaagatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccatgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactgttgccttcctaaattatgactgctgaatcatcatatctactatatatgactagaagaagtggttcttcaagtcaaccctcttacaggacttagtggaatttgctttatctactttaggccaaatccatcacacattggcttatttgaaacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttttataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattatctttattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggaaaaaaaaaaa

SEQ ID NO: 452370 - DNA, 1312 bp, Homo sapiens
tctctctctctctctctctctctctctctgtctctcctcgtgccggattcggcacgatgtatagtatactgttgccttcctaaattatgactgctgaatcatcatatctactatatatgactagaagaagtggttcttcaagtcaaccctcttacaggacttagtggaatttgctttatctactttaggccaaatccatcacacattggcttatttgaaacttttggttttcctctgtttttaaacatcttaggtataacagcacaatttcaccttgaaaaagcaccaaaattatggtgttcctgaaaagatcctattgtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttttataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattatctttattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggaaaaaaaaaaa

SEQ ID NO: 452371 - DNA, 2003 bp, Homo sapiens
gccacgtgacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggtgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcttgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggtaacttaaacaacaaacagaaaccagaccacctttaactccctttgtgctcgtctcccccgcttcttgcgtgaggcatggaaaacgatgagtcactccacttctgtttagggaatcagtgaacccattgaaaactgaaatctgcccttgcttcttaattccctgttcattgtttcaaaagtcgttgttcctctactttcatttctaagtaagacaggaaacgaaccaaggtcctagcagctgtgctgcaggttggaacataagttgcccgccaatcgaa

SEQ ID NO: 452372 - DNA, 391 bp, Homo sapiens
gtccctggaacttggactgttttctgaggtattgcaagcatgaacttttaaattgccttgtgtggtgtgctgtgggcttctgtgatcatgaagtaacatgcatttttcttaaaacttttcagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtgggtaagaaagtgcagggccacctccacccaggaagaatggtactaccaactgaccagttttcctgtgtctttgctggtt

SEQ ID NO: 452373 - DNA, 4058 bp, Homo sapiens
gccacgtgacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggtgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcttgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccatgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactgttgccttcctaaattatgactgctgaatcatcatatctactatatatgactagaagaagtggttcttcaagtcaaccctcttacaggacttagtggaatttgctttatctactttaggccaaatccatcacacattggcttatttgaaactttatcatctttcaccttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttttataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattatctttattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggaaaaaaaaaaa

SEQ ID NO: 452374 - DNA, 4042 bp, Homo sapiens
gccacgtgacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggtgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtcttacctcctatgtcctggagtgctgacttctgattatgagaccttacccaagaagcatactactgagaaatatattttcctcggcggtctgtgtgatctatcctaactcacagtgagctgaggatgagaagtgggcatttgggaaaggagaacagtgctcttgccctgatctgttgcttttgttgctgtgacttggcagctagtgtccctggaacttggactgttttctgagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccatgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactgttgccttcctaaattatgactgctgaatcatcatatctactatatatgactagaagaagtggttcttcaagtcaaccctcttacaggacttagtggaatttgctttatctactttaggccaaatccatcacacattggcttatttgaaactttatcatctttcaccttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttttataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattatctttattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacaggaaaaaaaaaaa

SEQ ID NO: 452375 - DNA, 3375 bp, Homo sapiens
gccacgtgacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggtgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcttgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccatgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactgttgccttcctaaattatgactgctgaatcatcatatctactatatatgactagaagaagtggttcttcaagtcaaccctcttacaggacttagtggaatttgctttatctactttaggccaaatccatcacacattggcttatttgaaacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgatatggtcaagaaaagggggctggggctcctaggcttgtatctatttcagctatcactgaattcctatctttagggcctcactcccc

SEQ ID NO: 452376 - DNA, 1282 bp, Homo sapiens
gccacgtgacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggtgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcttgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaaggtaacttggctgtgccacgtcttgggactgtgtgtgcgatgtggccttggggctgtgtgtggcagagctgtggtgtttggctttgtgattcttctgtttattaacattctcattttggacaaaagagataaccttcccttctcccttcccccttcctcct

SEQ ID NO: 452377 - DNA, 1583 bp, Homo sapiens
ccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttcggtcgctgctgtagtgcgcttcctgcggccaggcccgggttcaatcagcggccgacaactgtctagggctcagacaccaccagccaatgagggagggcacgtggagccgcccgtctgggctcgcggctcctggaccaatggggaagtggcatgtgggagggcgccggggttccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtccttgcagaattatagtgaataccaaaatggggttttgccccaggaggctcctaccagtttctgctttccagttgcagagtttggggggttattcattcccatttatctctcaacccaccagtgctgaaaataccagagcaggacataggggctggggccagctgatgtgtgtgggtgtgtaccactagagggcagcaggcactcagcagaaaggaggtggcgggggcggggggtgctgcgcttgataccctgccc

SEQ ID NO: 452378 - DNA, 1220 bp, Homo sapiens
gcggccgcctactactactactactgctcgaattcaagcttctaacgatgtacggggacatgaggggattcccttccttctgttgctggtgtactctaggacttcaaagtgtgtctgggatttttttattaaagaaaaaaaatttctagctgtcaagcacaaaaaaaacaaaaacaacaaacacaaaaaacacggtggggcgccgccacccagcgacccccggaagacaagctaagaagcccaccacgccgggaggggcgggcggacccccaggaaaggcagcggtacaccacgggcccaaagccgggaatcccaaccggagaccccgggaccacaggcacaaagcgagcgcgaaaaccaccacaccacacaaaacaacaacacgccccggcgcagccaacacagcgaggcgaataacaagaaaaccaacaccacacaggcaagaccaacggaagacgcaaaaaaagggagagaataaacgaaaccaagagcacgccaccacggaacacaacgcgaaacaaagcaaaaaacagtcccacaacgcacagaggtgaccaagcgcacaacacaaaccaccacaaccacacaccacaacacaaacagaccaaacccgcgaaaaaaaaaggcgaagagagaaggagacgaaaaaggagaaacggaagagaaagaaagaagaaaagagagcaagggagagaggagagaacgccgcgcgcaaaggcaggagacgacgacgacacagacaagggacaggggagaagagaacgcagaacagacggcgagcgaggggggaggggaggggcgggggggaaggggggcgcggaaacggcggggccaacgaggaggcggggggggggaagaagaggggcagaggaggcgcggggcaaggagggggagggagcgagacagggagccgagaggggggagggaggaggagcggagggcgagggcgccagagcgcggcgaacgcgagaggggaggcaaccagaaggagaggaagcggaggaggacgaggaggggagacgacgagagcgcagggcgacgggaggggaagagacagcagggagagcaggaaacggaaaggggggacgccagaggaccgcgagggagggggccggcgagagaaggcgcagaggcggacgagagaagagaaggagccaggagaacggggaggggggaaaggaacaggaaaagaacacaacgtacgcaaacagaaagccaga

SEQ ID NO: 452379 - DNA, 2394 bp, Homo sapiens
ccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttcggtcgctgctgtagtgcgcttcctgcggccaggcccgggttcaatcagcggccgacaactgtctagggctcagacaccaccagccaatgagggagggcacgtggagccgcccgtctgggctcgcggctcctggaccaatggggaagtggcatgtgggagggcgccggggttccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtcaagcacaaaaaaaacaaaaacaacaaacacaaaaaacacggtggggcgccgccacccagcgacccccggaagacaagctaagaagcccaccacgccgggaggggcgggcggacccccaggaaaggcagcggtacaccacgggcccaaagccgggaatcccaaccggagaccccgggaccacaggcacaaagcgagcgcgaaaaccaccacaccacacaaaacaacaacacgccccggcgcagccaacacagcgaggcgaataacaagaaaaccaacaccacacaggcaagaccaacggaagacgcaaaaaaagggagagaataaacgaaaccaagagcacgccaccacggaacacaacgcgaaacaaagcaaaaaacagtcccacaacgcacagaggtgaccaagcgcacaacacaaaccaccacaaccacacaccacaacacaaacagaccaaacccgcgaaaaaaaaaggcgaagagagaaggagacgaaaaaggagaaacggaagagaaagaaagaagaaaagagagcaagggagagaggagagaacgccgcgcgcaaaggcaggagacgacgacgacacagacaagggacaggggagaagagaacgcagaacagacggcgagcgaggggggaggggaggggcgggggggaaggggggcgcggaaacggcggggccaacgaggaggcggggggggggaagaagaggggcagaggaggcgcggggcaaggagggggagggagcgagacagggagccgagaggggggagggaggaggagcggagggcgagggcgccagagcgcggcgaacgcgagaggggaggcaaccagaaggagaggaagcggaggaggacgaggaggggagacgacgagagcgcagggcgacgggaggggaagagacagcagggagagcaggaaacggaaaggggggacgccagaggaccgcgagggagggggccggcgagagaaggcgcagaggcggacgagagaagagaaggagccaggagaacggggaggggggaaaggaacaggaaaagaacacaacgtacgcaaacagaaagccaga

SEQ ID NO: 452380 - DNA, 1642 bp, Homo sapiens
ccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttcggtcgctgctgtagtgcgcttcctgcggccaggcccgggttcaatcagcggccgacaactgtctagggctcagacaccaccagccaatgagggagggcacgtggagccgcccgtctgggctcgcggctcctggaccaatggggaagtggcatgtgggagggcgccggggttccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtcctcgtgccaattcggcacgaggcggcacgaggaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggt

SEQ ID NO: 452381 - DNA, 861 bp, Homo sapiens
  misc_feature (11)..(11): n is a, c, g, or t
  misc_feature (34)..(34): n is a, c, g, or t
  misc_feature (36)..(36): n is a, c, g, or t
  misc_feature (41)..(42): n is a, c, g, or t
  misc_feature (45)..(45): n is a, c, g, or t
gcgaaggaaanaccaaactaaggctaggtacgangnctggnngtngggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtcaaaaaaaaaaacaaaccacaaaaaacaaacccgcgc

SEQ ID NO: 452382 - DNA, 2075 bp, Homo sapiens
ccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttcggtcgctgctgtagtgcgcttcctgcggccaggcccgggttcaatcagcggccgacaactgtctagggctcagacaccaccagccaatgagggagggcacgtggagccgcccgtctgggctcgcggctcctggaccaatggggaagtggcatgtgggagggcgccggggttccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttggtaagtagctggtgatcctccccaactggccctggctcatgttaaccctcggcttcaccagccgtttgataaaaggccttgcccacctctctgttcaggaagccagctactctctccataaactaatgtgagaagactgaagtgcttctatgtccttcccaaagcagcatgtgttctgcaactgtgatttttttttatcctgttagtctttattaagcacctactatgtgctaggcactgggaatatcaggggaaagaagtgacagtcggacacacaaataatgcaatgtctgggtgtcatgaagaaaatggaccagcaggtgctgatttagagtggccaagaagtctctgaggaagggttatcattgaagtggggtaagaccatcccatacagggaacagcagtgtgagtgcccagaggcctgaaagagtgtggcatgtatgtggacaggagaaggtgacagggtgcctacaggataggcaagggccgaatccaagacaaaagccctagtgaagcaatgggttttctaacttgaatttctctgacagtctctggcttttctctctgttaaaggtttgaaccctggtgacacttaaattcatttggtggctgtcagcttggactgagcatgtgttaagagtccagggtttacactggctgaatctgactaccagtacaggcagggcaccgaaaaatgccgctgtgggccagtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtcaaaaaaaaaaacaaaccacaaaaaacaaacccgcgc

SEQ ID NO: 452383 - DNA, 1481 bp, Homo sapiens
gcggccgcctactactactactactgctcgaattcaagcttctaacgatgtacggggaacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtcaagcacaaaaaaaacaaaaacaacaaacacaaaaaacacggtggggcgccgccacccagcgacccccggaagacaagctaagaagcccaccacgccgggaggggcgggcggacccccaggaaaggcagcggtacaccacgggcccaaagccgggaatcccaaccggagaccccgggaccacaggcacaaagcgagcgcgaaaaccaccacaccacacaaaacaacaacacgccccggcgcagccaacacagcgaggcgaataacaagaaaaccaacaccacacaggcaagaccaacggaagacgcaaaaaaagggagagaataaacgaaaccaagagcacgccaccacggaacacaacgcgaaacaaagcaaaaaacagtcccacaacgcacagaggtgaccaagcgcacaacacaaaccaccacaaccacacaccacaacacaaacagaccaaacccgcgaaaaaaaaaggcgaagagagaaggagacgaaaaaggagaaacggaagagaaagaaagaagaaaagagagcaagggagagaggagagaacgccgcgcgcaaaggcaggagacgacgacgacacagacaagggacaggggagaagagaacgcagaacagacggcgagcgaggggggaggggaggggcgggggggaaggggggcgcggaaacggcggggccaacgaggaggcggggggggggaagaagaggggcagaggaggcgcggggcaaggagggggagggagcgagacagggagccgagaggggggagggaggaggagcggagggcgagggcgccagagcgcggcgaacgcgagaggggaggcaaccagaaggagaggaagcggaggaggacgaggaggggagacgacgagagcgcagggcgacgggaggggaagagacagcagggagagcaggaaacggaaaggggggacgccagaggaccgcgagggagggggccggcgagagaaggcgcagaggcggacgagagaagagaaggagccaggagaacggggaggggggaaaggaacaggaaaagaacacaacgtacgcaaacagaaagccaga

SEQ ID NO: 452384 - DNA, 1271 bp, Homo sapiens
ccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttcggtcgctgctgtagtgcgcttcctgcggccaggcccgggttcaatcagcggccgacaactgtctagggctcagacaccaccagccaatgagggagggcacgtggagccgcccgtctgggctcgcggctcctggaccaatggggaagtggcatgtgggagggcgccggggttccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaaggtgcgggatagggggccgggggccgcgctccgtgaccgttctggcggcggcgctgaaccccacaacatcaccagacggccggggccaagagggcgagggcgggggcgggggcgggggcgacagcaggtccccgcggggcctgcatgaggaggctccggcgcccgccctagtaaatctttcttgggcctagaaaacattggtccgacgaagaaaagttgagactagatcccgttgaaaacttgtcctgaaatctccatcactcctgagttattgtccccaccaccatctagaggttaccgctccccgttcggcgtcgggagctccagggctggccgtgggtgctgcgccctgtctgttgggatcacgaagctgcacctctgggtccgctgttgtatttggaaattagcagcagcattttgatcatttttctcttcaccttccagtctctccatttatgaggtcacagtgagtcccgtctcaaggacacgtgttcaccatgggcttaaacttgatgaaaggagcagggagaagtcgtttataggtcattgggtgatgcttggtcctttgatgccctgggtgtaccaggggacccccgccacttggaaccgggttctgtctacctgtagacacctgagaaaaatcggtgatggaaa

SEQ ID NO: 452385 - DNA, 152 bp, Homo sapiens
gggaggatcaccacccaacagattgaagctgcagggagccgtgatcatgccactgcattccagcctgggtgacagggagccctatctcaaaacacaagtaaggccctacagagagatgatgtttcaaggtgtcagtatgtttggaggagatg

SEQ ID NO: 452386 - DNA, 398 bp, Homo sapiens
agcatctcccgtccctctcttttccagtttgtatttcttatctgggaagattttaccaggacctcaaagacagagatgtcacattctcaccagccactattgaaaacgaacttataaagttctgccgggaagcaagaggcaaagagaatcggttggtaagtagctggtgatcctccccaactggccctggctcatgttaaccctcggcttcaccagccgtttgataaaaggccttgcccacctctctgttcaggaagccagctactctctccataaactaatgtgagaagactgaagtgcttctatgtccttcccaaagcagcatgtgttctgcaactgtgatttttttttatcctgttagtctttattaagcacctactatgtgctaggcactggga

SEQ ID NO: 452387 - DNA, 1364 bp, Homo sapiens
ccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttcggtcgctgctgtagtgcgcttcctgcggccaggcccgggttcaatcagcggccgacaactgtctagggctcagacaccaccagccaatgagggagggcacgtggagccgcccgtctgggctcgcggctcctggaccaatggggaagtggcatgtgggagggcgccggggttccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtcaaaaaaaaaaacaaaccacaaaaaacaaacccgcgc

SEQ ID NO: 452388 - DNA, 872 bp, Homo sapiens
acataacggtcaggtacgaggctggtgtgaatcggcagaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtcaaaaaaaaaaacaaaccacaaaaaacaaacccgcgc

SEQ ID NO: 452389 - DNA, 1502 bp, Homo sapiens
ccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttcggtcgctgctgtagtgcgcttcctgcggccaggcccgggttcaatcagcggccgacaactgtctagggctcagacaccaccagccaatgagggagggcacgtggagccgcccgtctgggctcgcggctcctggaccaatggggaagtggcatgtgggagggcgccggggttccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttggtttgaaccctggtgacacttaaattcatttggtggctgtcagcttggactgagcatgtgttaagagtccagggtttacactggctgaatctgactaccagtacaggcagggcaccgaaaaatgccgctgtgggccagtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcctgatgatgctggccctacagtacccccatgaggggattcccttccttctgttgctggtgtactctaggacttcaaagtgtgtctgggatttttttattaaagaaaaaaaatttctagctgtcaaaaaaaaaaacaaaccacaaaaaacaaacccgcgc

SEQ ID NO: 452390 - DNA, 1533 bp, Homo sapiens
ccgcccttcctgcctaacctgttgtcttggctgaccccagaactcctgcaccacgagtcggagtccgggcgaggagatcagcaggggttttcgagggagcctggggcccagggcaggggtacgcgggtcaactcaacagatgtaaggcgtggccgaaccccattcagctagcagtacccagcctcagccacagtcgctgcccttacccaagatggcggcccacaccgcttcggtcgctgctgtagtgcgcttcctgcggccaggcccgggttcaatcagcggccgacaactgtctagggctcagacaccaccagccaatgagggagggcacgtggagccgcccgtctgggctcgcggctcctggaccaatggggaagtggcatgtgggagggcgccggggttccccccgccaatggggagctacggcgcgcggccgggacttggaggcggtgcggcgcggcgggtgcggttcagtcggtcggcggcggcagcggaggaggaggaggaggaggaggatgaggaggatgaggaggatgtgggccacgcaggggctggcggtggcgctggctctgagcgtgctgccgggcagccgggcgctgcggccgggcgactgcgaagtttgtatttcttatctgggaagattttaccaggacctcaaagacagagatgtcacattctcaccagccactattgaaaacgaacttataaagttctgccgggaagcaagaggcaaagagaatcggttgtgctactatatcggggccacagatgatgcagccaccaaaatcatcaatgaggtatcaaagcctctggcccaccacatccctgtggagaagatctgtgagaagcttaagaagaaggacagccagatatgtgagcttaagtatgacaagcagatcgacctgagcacagtggacctgaagaagctccgagttaaagagctgaagaagattctggatgactggggggagacatgcaaaggctgtgcagaaaagtctgactacatccggaagataaatgaactgatgcctaaatatgcccccaaggcagccagtgcacggaccgatttgtagtctgctcaatctctgttgcacctgagggggaaaaaacagttcaactgcttactcccaaaacagcctttttgtaatttattttttaagtgggctcctgacaatactgtatcagatgtgaagcctggagctttcgttgctggtgtactctaggacttcaaagtgtgtctgggatttttttattaaagaaaaaaaatttctagctgtccttgcagaattatagtgaataccaaaatggggttttgccccaggaggctcctaccagtttctgctttccagttgcagagtttggggggttattcattcccatttatctctcaacccaccagtgctgaaaataccagagcaggacataggggctggggccagctgatgtgtgtgggtgtgtaccactagagggcagcaggcactcagcagaaaggaggtggcgggggcggggggtgctgcgcttgataccctgccc

SEQ ID NO: 452391 - DNA, 3382 bp, Homo sapiens
tccggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattcccttgaagctgtgaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaataccttttgctagcctcttcatatgctgttgcatatgactctcatcacaactcagtgagatggaaagacaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcaataaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgcatatgtc

SEQ ID NO: 452392 - DNA, 872 bp, Homo sapiens
tccggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggtgagctggccgtcgcggtgactatgacggggctgtcagtgttgcccgataaagtttacttaatgctcctaaaagagccacgaagtggctgtcattcctactggaagcatgaaaagcccctgaaactcaaagaagttaagcaaaacacgaatttcagagctagggttaaaactggaatgagaggaggggaggtgcaaacctcagcaatcattgtgcagaattttcaataaactggcccttggggagctcataataaagaaaaacacctcgtgccgagt

SEQ ID NO: 452393 - DNA, 2633 bp, Homo sapiens
tccggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattcccttgaagctgtgaaggtgaagacagtgtgccagataccattgatgaaggaaatgctaaagcgattccaagcaactaaaataaaaacacaaaaacaaaacaggcacaatatgtgaaacaaccgttttcaaagcaccagacgtcaggcagtgaagggcggtgattcctgagaaatgtgaaacaaatgaggtcagcctatgattgccctaccctctgcctgagggagtttccagaccatgtaaggctgaggtaactgaggtagagccagggagacttgctgagttgaggaatagacctgggagttcacggagaacaaagtagtgagagttcgcaaagtactgggcagtatcctggagcggagagagccggacacagagagaaccctcgccatctatggaggagcttcctagttgtttggcagagttctgatcagcacatgcctgtgaaaatctactcaaggctggagatagaagcttctaaaacgattagagggaacggttcctggtgctcacacagggccaggaacagtgccagttcctatcagccacaccagaaaactcgtagttcacgggcactgagtagcgtactcaggaaaatcttgcctcattagcagaaaatatttagcccttgactgggtgctgctccacacccaccttacaaatcatgaaagcaagacccaaaggggtcaaactctttccaactaacttaactgcatcccaggataaagccctagaaaattggtagaaataaacaaaaaaagagcacctaacaatataaattcacaatgtctggcatccagtcaaatatgcatgcaaaaagataggaaagcagtgacccataatggaggaaaataatcaactgaaactgacctagaattgacacagatgttagaataagcatggaaggactttaaaacatttattatgagtgtattctgtaaagaggtacatagagaccagatcaaagttttaaagatgaaaaatgtgattaaggcgaagaatgcactggatgggattaatagttgattaaatattacaaaagaaaaaattggtgaacttgaagacagagcaatggaaactacaaaaaaatgaaacatacacagaataaaacaatttacaaaaacacaaagagcatcagtgacctgtgggacaactttatgcagccttattatctatggtgattggcgtccctgaaagagaggagtggggagggagatggaataggaaaaatacttgaagacataatggccaaagattttctgaatataataaaaactaagtccacagatccaagatgctcaacaaaccctgagtatgagaaatatgaagaaaaatatgccaaggctcatcataacttgctggaaaccagtgttaaaaagaaaatcttaaatgcaaccaggggagaggatagttacttgcagtggaacaaagacgaagttgacattacacttctcattggaaacaatgccagtaagcaaactctttaaagtcctgaaagaaaaaaactgttaactctttcttttaagctttagtttacctccaaacttatttatttcacctttgtttttgaaggatatttttttgccagctctagaactctaggttaacagtttttttctttcaggactttaaagagtttgcttactggcattgtttccaatgag

SEQ ID NO: 452394 - DNA, 1868 bp, Homo sapiens
tgacacaggggctaggcatgccctgtgatgggagcagaatagtgaagcgattccctattgactaatgcctaggtgtattaagttcattgctttgcgaaaggtaaggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaataccttttgctagcctcttcatatgctgttgcatatgactctcatcacaactcagtgagatggaaagacaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcaataaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgcatatgtc

SEQ ID NO: 452395 - DNA, 1257 bp, Homo sapiens
tccggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcaggtgagacagttacgagtgggggtgatctcatcttcactaactgaactctctcttgtctttagagctgaatgtccttcctggtgagtgggtttcatagacatgtcttatctcttgctagttctgtgctgtcacataactaaaaagccaaagattcaccattcaaaggaaattaatgtgaaatgtaggtatgctgagctcagctcataggagataagttgattcacacagtctcatagttcatctaggatctgagacttagcacatataagatttttttcattcatcttatgtgtacatttataattattaaacaataaaacaaagcaagcataaaac

SEQ ID NO: 452396 - DNA, 1150 bp, Homo sapiens
agcacctaacaatataaattcacaatgtctggcatccagtcaaatatgcatgcaaaaagataggaaagcagtgacccataatggaggaaaataatcaactgaaactgacctagaattgacacagatgttagaaataaacaaaaaaagagcacctaacaatataaattcacaatgtctggcatccagtcaaatatgcatgcaaaaagataggaaagcagtgacccataatggaggaaaataatcaactgaaactgacctagaattgacacagatgttagaataagcatggaaggactttaaaacatttattatgagtgtattctgtaaagaggtacatagagaccagatcaaagttttaaagatgaaaaatgtgattaaggcgaagaatgcactggatgggattaatagttgattaaatattacaaaagaaaaaattggtgaacttgaagacagagcaatggaaactacaaaaaaatgaaacatacacagaataaaacaatttacaaaaacacaaagagcatcagtgacctgtgggacaactttatgcagccttattatctatggtgattggcgtccctgaaagagaggagtggggagggagatggaataggaaaaatacttgaagacataatggccaaagattttctgaatataataaaaactaagtccacagatccaagatgctcaacaaaccctgagtatgagaaatatgaagaaaaatatgccaaggctcatcataacttgctggaaaccagtgttaaaaagaaaatcttaaatgcaaccaggggagaggatagttacttgcagtggaacaaagacgaagttgacattacacttctcattggaaacaatgccagtaagcaaactctttaaagtcctgaaagaaaaaaactgttaacctagagttctagaactggcaaaaaatatccttcaaaaacaaaggtgaaataaataagtttggaggtaaactaaagcttaaaagaaagagtttacagcagactgacacttcaagaaaggaagtcttaaaggaagtccttcagacagaaggaaaatgccagatggaaatctctctacacaaaggaataaaagagcaccagaaatggtaatgacacgaataaatatatattattgtcattatttattcctttaa

SEQ ID NO: 452397 - DNA, 799 bp, Homo sapiens
tgagatccaggatgtgaactattcccttgaagctgtgaaggtgaagacagtgtgccagataccattgatgaaggaaatgctaaagcgattccaaggtgagcagaatttctaggacttggggctccttagaaatctttcaaataggagaataaagagagaagtctggagaggaaagaggaaacagcatgcagctaatagagtgtcaggaaaggtggttaataaatgggtatacacttcattcaagaaacatttatttaacgcactgttacaaggtgctagtgatacaaaaagaagagacctgttcacttcttcatgagttcgtaagcacattggagagacagacacacagcactcacagtgatatagtaggagccagtgtttgctggtggtaggaataaaatgttacagaaattcagaggaagggctctgttgggggcgagatgggaaagttttcacagcagaggcgacagttttgagatttgagggattagtaggagtttggcaggtggaaaacagggatgactgtttcaagcagaagcagcagcatgagctaaggtgtggagaacatggaggggtgggtatccaaagaggctaaagaacaaggtgtattttgaggaaaggtagaggttgaggttgagaagaagagtgtaggacagactgaaaataaactcattggatctccagggaggcaccaaggcaggtacatgctctagaagctgtgctggtgattcttatgtgcacatgtttgattaagaaccatgttgtaggccgggcacgaaggctcatgtctgtaatccca

SEQ ID NO: 452398 - DNA, 3460 bp, Homo sapiens
tccggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccggacaggtaactttgacatccacgtggatgaatggaagagaagactaattaggctgctcttgtaccattctaagcaggaggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattcccttgaagctgtgaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaataccttttgctagcctcttcatatgctgttgcatatgactctcatcacaactcagtgagatggaaagacaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcaataaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgcatatgtc

SEQ ID NO: 452399 - DNA, 2733 bp, Homo sapiens
tccggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattcccttgaagctgtgaaggtgaagacagtgtgccagataccattgatgaaggaaatgctaaagcgattccaagcaactaaaataaaaacacaaaaacaaaacaggcacaatatgtgaaacaaccgttttcaaagcaccagacgtcaggcagtgaagggcggtgattcctgagaaatgtgaaacaaatgaggtcagcctatgattgccctaccctctgcctgagggagtttccagaccatgtaaggctgaggtaactgaggtagagccagggagacttgctgagttgaggaatagacctgggagttcacggagaacaaagtagtgagagttcgcaaagtactgggcagtatcctggagcggagagagccggacacagagagaaccctcgccatctatggaggagcttcctagttgtttggcagagttctgatcagcacatgcctgtgaaaatctactcaaggctggagatagaagcttctaaaacgattagagggaacggttcctggtgctcacacagggccaggaacagtgccagttcctatcagccacaccagaaaactcgtagttcacgggcactgagtagcgtactcaggaaaatcttgcctcattagcagaaaatatttagcccttgactgggtgctgctccacacccaccttacaaatcatgaaagcaagacccaaaggggtcaaactctttccaactaacttaactgcatcccaggataaagccctagaaaattggtagaaataaacaaaaaaagagcacctaacaatataaattcacaatgtctggcatccagtcaaatatgcatgcaaaaagataggaaagcagtgacccataatggaggaaaataatcaactgaaactgacctagaattgacacagatgttagaataagcatggaaggactttaaaacatttattatgagtgtattctgtaaagaggtacatagagaccagatcaaagttttaaagatgaaaaatgtgattaaggcgaagaatgcactggatgggattaatagttgattaaatattacaaaagaaaaaattggtgaacttgaagacagagcaatggaaactacaaaaaaatgaaacatacacagaataaaacaatttacaaaaacacaaagagcatcagtgacctgtgggacaactttatgcagccttattatctatggtgattggcgtccctgaaagagaggagtggggagggagatggaataggaaaaatacttgaagacataatggccaaagattttctgaatataataaaaactaagtccacagatccaagatgctcaacaaaccctgagtatgagaaatatgaagaaaaatatgccaaggctcatcataacttgctggaaaccagtgttaaaaagaaaatcttaaatgcaaccaggggagaggatagttacttgcagtggaacaaagacgaagttgacattacacttctcattggaaacaatgccagtaagcaaactctttaaagtcctgaaagaaaaaaactgttaacctagagttctagaactggcaaaaaatatccttcaaaaacaaaggtgaaataaataagtttggaggtaaactaaagcttaaaagaaagagtttacagcagactgacacttcaagaaaggaagtcttaaaggaagtccttcagacagaaggaaaatgccagatggaaatctctctacacaaaggaataaaagagcaccagaaatggtaatgacacgaataaatatatattattgtcattatttattcctttaa

SEQ ID NO: 452400 - DNA, 2413 bp, Homo sapiens
tccggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattcccttgaagctgtgaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgcccttgcacaatcttcactcttaggcataggctgtgccatcttagccaactcaaacggtctctaggttttatatcctatctgttttagttactcctacattttta

SEQ ID NO: 452401 - DNA, 896 bp, Homo sapiens
  misc_feature (865)..(865): n is a, c, g, or t
  misc_feature (872)..(872): n is a, c, g, or t
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatggttatgcaactactggttgccaaccccaaaacaagttcttgtnccaaaanaagccccggttaacggggcacaaa

SEQ ID NO: 452402 - DNA, 490 bp, Homo sapiens
ctggctttactgcaccagactctcagtagatcttgtgggtacagatcctccacacttctgtaatcacttggctcatagtctgctgtcctgatgataagatgccattgggcctgttgatcacaattcctggagtgggattgtcttcagagtaagcaatgtcatcgtacatcatcacaacgatctgttcgtcaggaatcccattgcggtgaatgatctggtaggcatggcacgcgtctgcctgggagaaatgatttggagaagcagtgaagggcataggatccggcaaagtcctgaagaggtaatgtctgtttatggatactacacttctctcaatggcttgggacccccgtatagagaattgaaacaggtgttgttctgtgcccctagcctgtttacctgtgagaaattacagagtggagagttttgttctgacttaggacaggtgcttagggctgttgtttcagtggcttctcttggtggcccatttctg

SEQ ID NO: 452403 - DNA, 1982 bp, Homo sapiens
  misc_feature (10)..(10): n is a, c, g, or t
  misc_feature (18)..(18): n is a, c, g, or t
  misc_feature (51)..(51): n is a, c, g, or t
  misc_feature (53)..(53): n is a, c, g, or t
gccgcagacncgtgcganacaggggaccactgtcgctcgggcccgggcgtngncggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452404 - DNA, 1974 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452405 - DNA, 1990 bp, Homo sapiens
cgcggcacagtggcccttaagcgaggagcggcggcgcccgcagcaatcacagcagtgccgacgtcgtgggtgtttggtgtgaggctgcgagccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452406 - DNA, 2207 bp, Homo sapiens
ctgtaatgactacagccacttcctccaaaggaaccctgcttccctggggttcagggacctggggtcatcacatataagccagtggagctcctctcccaggctcacctcacagggcctccacggagaggtaagccaaagcagaatgggggcaggagggtctctataagatagaaacccctaagaaacaccatttaaacacaaaggctttttttttcctcctgagacgaggtcttactctgttgcccaggctggagtgcagtggcacaatcttggctcactgcaacctctgcctcccgggttcaagcaattctcctgcctcagcctcccgagtagctgggattacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452407 - DNA, 1874 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggattacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452408 - DNA, 1981 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452409 - DNA, 2212 bp, Homo sapiens
ctgtaatgactacagccacttcctccaaaggaaccctgcttccctggggttcagggacctggggtcatcacatataagccagtggagctcctctcccaggctcacctcacagggcctccacggagaggtaagccaaagcagaatgggggcaggagggtctctataagatagaaacccctaagaaacaccatttaaacacaaaggctttttttttcctcctgagacgaggtcttactctgttgcccaggctggagtgcagtggcacaatcttggctcactgcaacctctgcctcccgggttcaagcaattctcctgcctcagcctcccgagtagctgggattacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccagcttttagacactgcctgcagctgttggctcatggccccttcttccatcctcaatgccaacaagggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttacccccccggcttcttggcagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452410 - DNA, 2081 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaatttaaaaccccaataaataaatttttttaaagcgggggagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452411 - DNA, 1390 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452412 - DNA, 1104 bp, Homo sapiens
ccatactgtttcttctagtggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccctgatgtgcctctcaccatcatgaaaaggaaactgatgaacaccaatgatctggaggagtccaggcagctcacggaggagatccagcggcatctggatggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452413 - DNA, 1168 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggctgatgtgcctctcaccatcatgaaaaggaaactgatgaacaccaatgatctggaggagtccaggcagctcacggaggagatccagcggcatctggatggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452414 - DNA, 840 bp, Homo sapiens
aaaccctggcatgtgtgcctctttcctgagggatcgtccataaatatcaccagattatctaaaggttgggaaaggatccatgaaccaaaatagggcaagagccactggtcaagatgcttcccctctgcaattgcaaaagtggagtggattgtgtggtgagatgaggaagtttcattcttctcgtttgttttctcccagtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452415 - DNA, 1118 bp, Homo sapiens
aaaccctggcatgtgtgcctctttcctgagggatcgtccataaatatcaccagattatctaaaggttgggaaaggatccatgaaccaaaatagggcaagagccactggtcaagatgcttcccctctgcaattgcaaaagtggagtggattgtgtggtgagatgaggaagtttcattcttctcgtttgttttctcccagtacgagtatgcgttgagacatttgtacgtgctggtcaacctttgtgagaagccgtatccgcttcacaggtaactaatgcagcggtgacgcttgaaaggtcgatgtcattctgaaagcagaaggggctgccatcctcttctgcaagtgggcattttcacttctgccaggagctccctccagctttcctctacagccatttgtcagcagggtccagaagccacgttctcagtgacagctgctgggcgggcctgtcataactgcctgcctgccgcatgtgggtttgcgtttgtctgcctttcttcagagttgacacggttcaccaagttctccttcctgtctctcgcaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452416 - DNA, 1034 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcgtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452417 - DNA, 487 bp, Homo sapiens
  misc_feature (147)..(147): n is a, c, g, or t
  misc_feature (155)..(155): n is a, c, g, or t
  misc_feature (263)..(263): n is a, c, g, or t
  misc_feature (266)..(266): n is a, c, g, or t
  misc_feature (283)..(283): n is a, c, g, or t
  misc_feature (308)..(308): n is a, c, g, or t
  misc_feature (318)..(318): n is a, c, g, or t
  misc_feature (333)..(333): n is a, c, g, or t
  misc_feature (377)..(377): n is a, c, g, or t
  misc_feature (451)..(451): n is a, c, g, or t
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgncggcttcntctcctaggcgacgagacccagtggctagaagttcaccatgtctattctcaagatcatgccagggagatctttgactctcgcgggaatccacttgttgaggttgatcnctnacctcaaaaggtctctncagagctgctgtgccagtggtgctncaactggtanctatgaggcctaganctccgggacaatgataagactcgctatatggggaagggtgtctnaaaggctgttgagcacatcaataaaactattgcggctgccctggttagcaagaaactgaacgtcacagaacaanagaagattgacaaactgatgatcgagatggatggac

SEQ ID NO: 452418 - DNA, 362 bp, Homo sapiens
gtacatcctcttgccctttttaaatgcgtgcataaaacatgtgacgacattctggggttatgttcttcaccatgattacttctagggattggtagaaaagagtttatgaaggatcatcagaactttactagtggcttatccagcaaatagtttctcttgatgtgttggtctgacaatattctcacctttcagcttcatgtaaaggacctgaatgagaccatccattacatgtacaaacacaaaatgtaccgaaaggtaattcagcccttggggcagccttgtgggggcggggggtgtgaggaaagccgtgagtgcagagcccacagtcccgtgaccgtcctccaactgtgggtgctgtgttt

SEQ ID NO: 452419 - DNA, 408 bp, Homo sapiens
aatgtcaagatgttttccagagtggagtgccaattacactatacttccatcatagctgtattagtttactatcactgcttaaacagattgccacagacttcatggcttgaaacaatacaaatttattatcttacagttctggaggtaagaaatgtgaaatggctgtcactgggttaaatcacggtgttgcctgggctgtgttccttggtggctgtagtggaggctccactttctcgtcttttccagcttttagacactgcctgcagctgttggctcatggccccttcttccatcctcaatgccaacaagggtcagttgaatctttcttacactgcatcacttggacactgactcctgcctctgtctccacatacaaaagcctttgtgattacattaggcccactgaag

SEQ ID NO: 452420 - DNA, 2957 bp, Homo sapiens
actgaacccagccactgcccctgggcgtgaggacagggacccaggggcagtggctgggttcagtgttctcacgctcagaggaagaaaaggcagtggctgggttcagtgttctcacgctcagaggaagaaaaggcagtggtgaacacccgcctgactgccttaccctgatctaaacgacaccatctcctcccccaaggaagacacagccctggatgtgaacctaggagggtgggaatggcttatgtcactcggtctttgaggcagagcttgggctggggttgcaggggcatcagccaatctgctctcaaggagcaaaacttgggcgtaaaaggaacgggcagtggggctagccggctgtctggaggtctgggtgacctggcagcacggctgcttctcccccgccaccccgccccactccttgacacttccaggtgattttatctttataaataagatgaaaatccaagcagcattaatttaggggaacaaaagatggaaaaaaaagggggggaggcagaaggagctgatgagcatccaggagaggaggaagtaggaagagcagtgtccactgtgtgccccagggcagtggagtgtctctgtggctgcaaggcccttccttctggctccctggcagacggccagacagcagagggaactctgtattgactgggacaagccctggagccctgtctggctgttgacatggggagtgcctggatttgccccaatcaacctcccaccttcaccattgcccaagtgaagcagcttttaactctcttgcccaaagtcctctgagaatttcttcactttcaggaggtcgtctgcattcaccgtgggccgggtggtggccagagaccgcagcatgtccgacatgcaaaccacaggctctaagagtttgtccccagggacatccatccaagtcatctccatggctcctgggtcccctggtgagcatggagtcaggaggtcatcaatcatcatgctggggttggtgcgaggcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452421 - DNA, 2045 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452422 - DNA, 2049 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452423 - DNA, 2163 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacagggtcttactctgttgcccaggctggagtgcagtggcacaatcttggctcactgcaacctctgcctcccgggttcaagcaattctcctgcctcagcctcccgagtagctgggattacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452424 - DNA, 1948 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctggggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452425 - DNA, 2323 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggtaactaatgcagcggtgacgcttgaaaggtcgatgtcattctgaaagcagaaggggctgccatcctcttctgcaagtgggcattttcacttctgccaggagctccctccagctttcctctacagccatttgtcagcagggtccagaagccacgttctcagtgacagctgctgggcgggcctgtcataactgcctgcctgccgcatgtgggtttgcgtttgtctgcctttcttcagagttgacacggttcaccaagttctccttcctgtctctcgcaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452426 - DNA, 1810 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatggatgataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452427 - DNA, 2032 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttccgcaactcatccagcaggtgtacaattttttaacattttttaattaaaatagtacccaaa

SEQ ID NO: 452428 - DNA, 1177 bp, Homo sapiens
gcatgtctagtcaagtctcctgtcttggacaatgttcagcagtccactgcatatagacacacagaagaggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattaacgtccgacactgact

SEQ ID NO: 452429 - DNA, 1317 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagactcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatatgacagacatatagttgaactcatttggtctgaggttaaaggtctccactaacccgtaggtctctttccgatcagtagcgtaga

SEQ ID NO: 452430 - DNA, 983 bp, Homo sapiens
cgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagagggaggggatttaattttaattttaaaatgtttaggaaatttatacaaagaaactttttaataaagtatattgaaagtttcaaaaaaaaatcaaaaaa

SEQ ID NO: 452431 - DNA, 912 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttga

SEQ ID NO: 452432 - DNA, 537 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaatcctcagaatttaaatataataagccagccttcctcaagaatgccagacagtggacagagaagcatgcaagacagaaacaaaagcggctgatgagggagatgcttgatctcc

SEQ ID NO: 452433 - DNA, 442 bp, Homo sapiens
gagagaatatcgtatgcataatactgtatttaaatcttgcaacaaagaagtacatggaaataatattacagagcttcatttttctccatcctggcatttgtgtgaaccttactgtgtttcaccctgtctcctctttaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttga

SEQ ID NO: 452434 - DNA, 844 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatcccttcccccaaaaaaaaaa

SEQ ID NO: 452435 - DNA, 842 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcgtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttga

SEQ ID NO: 452436 - DNA, 857 bp, Homo sapiens
cttagaagatatgctggagtatttagaggtaaagtggcttgaatccaggtggtagatatatggatgttttcaatactgttatttcaaactgatttattttaaattttcatagtgaaaatttaggaagagagaaagtttgcctcccaaaggcagtctccctgacatttctataataccaaaattattgtgaccaagaaactatttaaatgtatttagaagcaaaattatgtaatgaaaattatctgttgtcttattctttcataggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttga

SEQ ID NO: 452437 - DNA, 1078 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatagtaaatatccccattttcctctgcaacacatatcctaccttgtctataccgctaactctccctgtgtgaggatagctgcagcagctctaaccactgcaaatcatgtttttctccattaactcttttctttgatttcatctcagtcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaacaacacaccaag

SEQ ID NO: 452438 - DNA, 1138 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaagtgagttgtgggtaaatggttgactctacagcattctgttttcttcatctattaaacttgaattagaggatcacattctaatatatcgcaactgtgttgacctctattcagctgctcatgtcagaacccaaccctgatgacccgctcatggctgacatagtaaatatccccattttcctctgcaacacatatcctaccttgtctataccgctaactctccctgtgtgaggatagctgcagcagctctaaccactgcaaatcatgtttttctccattaactcttttctttgatttcatctcagtcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaacaacacaccaag

SEQ ID NO: 452439 - DNA, 1081 bp, Homo sapiens
cttagaagatatgctggagtatttagaggtaaagtggcttgaatccaggtggtagatatatggatgttttcaatactgttatttcaaactgatttattttaaattttcatagtgaaaatttaggaagagagaaagtttgcctcccaaaggcagtctccctgacatttctataataccaaaattattgtgaccaagaaactatttaaatgtatttagaagcaaaattatgtaatgaaaattatctgttgtcttattctttcataggtacccatttgaacctcctcagatccgatttctcactccaatttatcatccaaacattgattctgctggaaggatttgtctggatgttctcaaattgccaccaaaagtgagttgtgggtaaatggttgactctacagcattctgttttcttcatctattaaacttgaattagaggatcacattctaatataaaagcaactgttcatctgtttgtatatagggtgcttggagaccatccctcaacatcgcaactgtgttgacctctattcagctgctcatgtcagaacccaaccctgatgacccgctcatggctgacatatctccctgtgtgaggatagctgcagcagctctaaccactgcaaatcatgtttttctccattaactcttttctttgatttcatctcagtcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaacaacacaccaag

SEQ ID NO: 452440 - DNA, 897 bp, Homo sapiens
ggtctcgctctgccacccaggctggagtgcagtggcgcgatcttggctcactgcaacctccgccttcctggttgaagccattctcctgcctcagccttccaagtagctgggattacaggcgtgcaccaccgtgagttgtgggtaaatggttgactctacagcattctgttttcttcatctattaaacttgaattagaggatcacattctaatataaaagcaactgttcatctgtttgtatatagggtgcttggagaccatccctcaacatcgcaactgtgttgacctctattcagctgctcatgtcagaacccaaccctgatgacccgctcatggctgacatagtaaatatccccattttcctctgcaacacatatcctaccttgtctataccgctaactctccctgtgtgaggatagctgcagcagctctaaccactgcaaatcatgtttttctccattaactcttttctttgatttcatctcagtcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaacaacacaccaag

SEQ ID NO: 452441 - DNA, 418 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacaaatccttccagcagaatcaatgttgggctgatcaattggagtg

SEQ ID NO: 452442 - DNA, 938 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaacaaaaagatttcccgagcgt

SEQ ID NO: 452443 - DNA, 935 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaacaacacaccaag

SEQ ID NO: 452444 - DNA, 640 bp, Homo sapiens
aacgagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaagactggctctaaacaggggggtaccgaactcga

SEQ ID NO: 452445 - DNA, 1365 bp, Homo sapiens
  misc_feature (1295)..(1295): n is a, c, g, or t
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaatanaacaaaatctccagggctcaatgccggggcggacaccgggttccggctgggcatgggcatacctgacctg

SEQ ID NO: 452446 - DNA, 1209 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452447 - DNA, 1872 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacaggatactgatcccctagaacccaagagtccaggtacctcttcccttcctttctcctctagggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452448 - DNA, 2509 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacaggatactgatcccctagaacccaagagtccaggtacctcttcccttcctttctcctctagggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaatcaaaaaaaaaaaaaaaaaaacaaaaaaaaaacaaaaagagaggcggggcgcgcccgcctctccatccatcttctcctcacgccagggggcacccaactcgcctcccccccccaccctctttttttttgccacgacaggggcgcccccaacatgagggcggtcctctctattctaattccatcaccagagcggcaccgcggccagcgtgatccaaacacagaacgtagagtggcgagacagaccaacgacgacgcgcgcgcaggaggaccgtctggggagggaaggccaccaaaaataacagagcctggagcgacggcaaaacaccagcgcgggaaccacacaccccccacgcagaagtagaaacagcccagcgaaggcagtacacaacacaaacaaacgcgagttgatccgggagacaacccacaggtacgacagccgcacggcgcgaagcgaaaaccggccccacagacaaagtacacatacgaaacaataacaaccccgcgggatcggagcgggaaccacacgcgccgtgacccgacgccaagccacgcgacaacacgtcgacacgaccaccacgaccgcgacacgccc

SEQ ID NO: 452449 - DNA, 1842 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacaggatactgatcccctagaacccaagagtccaggtacctcttcccttcctttctcctctagggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgcagaggatgattgccgccgtggacacagactccccccgagaggtctttttccgagtggcagctgacatgttttctgacggcaacttcaactggggccgggttgtcgcccctttctacttt

SEQ ID NO: 452450 - DNA, 1885 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaatcaaaaaaaaaaaaaaaaaaacaaaaaaaaaacaaaaagagaggcggggcgcgcccgcctctccatccatcttctcctcacgccagggggcacccaactcgcctcccccccccaccctctttttttttgccacgacaggggcgcccccaacatgagggcggtcctctctattctaattccatcaccagagcggcaccgcggccagcgtgatccaaacacagaacgtagagtggcgagacagaccaacgacgacgcgcgcgcaggaggaccgtctggggagggaaggccaccaaaaataacagagcctggagcgacggcaaaacaccagcgcgggaaccacacaccccccacgcagaagtagaaacagcccagcgaaggcagtacacaacacaaacaaacgcgagttgatccgggagacaacccacaggtacgacagccgcacggcgcgaagcgaaaaccggccccacagacaaagtacacatacgaaacaataacaaccccgcgggatcggagcgggaaccacacgcgccgtgacccgacgccaagccacgcgacaacacgtcgacacgaccaccacgaccgcgacacgccc

SEQ ID NO: 452451 - DNA, 1647 bp, Homo sapiens
  misc_feature (1625)..(1625): n is a, c, g, or t
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacaggatactgatcccctagaacccaagagtccaggtacctcttcccttcctttctcctctagggcccaccagctctgagcagatcatgaagacaggggcccttttgcttcaggggtgagtttgaggtctgattattgtggcacagatttgaggagtgacaccccgttctgattctgcaccctcactccatccccactctagtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaagccctgtgcaccaaggtgccggaactgatcagtataccntcggtaccgagctcgatcttaa

SEQ ID NO: 452452 - DNA, 1235 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452453 - DNA, 1409 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccacctcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452454 - DNA, 2042 bp, Homo sapiens
  misc_feature (1979)..(1979): n is a, c, g, or t
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacaggatactgatcccctagaacccaagagtccaggtacctcttcccttcctttctcctctagggcccaccagctctgagcagatcatgaagacaggggcccttttgcttcaggggtgagtttgaggtctgattattgtggcacagatttgaggagtgacaccccgttctgattctgcaccctcactccatccccactctagtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagagatgattgccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctgggccccaggattcccccagccaaactgtctttgtcaccacgtggggctcacttttcatccttccccaagttccctaggtccccgtactaggttggacagcccncttcggctacaggaaggcaggaggggtgagtcccctatccctcttcactgtggcacaggccca

SEQ ID NO: 452455 - DNA, 1725 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaatcaaaaaaaaaaaaaaaaaaacaaaaaaaaaacaaaaagagaggcggggcgcgcccgcctctccatccatcttctcctcacgccagggggcacccaactcgcctcccccccccaccctctttttttttgccacgacaggggcgcccccaacatgagggcggtcctctctattctaattccatcaccagagcggcaccgcggccagcgtgatccaaacacagaacgtagagtggcgagacagaccaacgacgacgcgcgcgcaggaggaccgtctggggagggaaggccaccaaaaataacagagcctggagcgacggcaaaacaccagcgcgggaaccacacaccccccacgcagaagtagaaacagcccagcgaaggcagtacacaacacaaacaaacgcgagttgatccgggagacaacccacaggtacgacagccgcacggcgcgaagcgaaaaccggccccacagacaaagtacacatacgaaacaataacaaccccgcgggatcggagcgggaaccacacgcgccgtgacccgacgccaagccacgcgacaacacgtcgacacgaccaccacgaccgcgacacgccc

SEQ ID NO: 452456 - DNA, 471 bp, Homo sapiens
cctcccgcctcagcctctcaaagtgctgggattacaggtgtgagccaccatgcctggcctgagtccagctctttaatgcccgttcatctcagtcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452457 - DNA, 317 bp, Homo sapiens
gccatgtttacaatttttgaagccgacttcaattgtgggtggcagaaatctttgaggggaggcaaagaattgacaaaggaggtttggggccactatctccaggcagtggggacaaggttcagtccctaacgcccactccactccccacaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccacc

SEQ ID NO: 452458 - DNA, 1287 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452459 - DNA, 1203 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctga

SEQ ID NO: 452460 - DNA, 2152 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacaggatactgatcccctagaacccaagagtccaggtacctcttcccttcctttctcctctagggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaagaacaaacacaacaggaacagaaagcaaaaaccggggcggccacaattggggggggggaacagaagcttatcgaaagggaccaggggcgaaaggtttttcgaaaccgctcttgtgcaaggggttaaatcgcgcggccccaatgggggcgataagtggcgaaccggtacctattttcgctactagctagggcagacacggccaacagaggagccagcgataaacagtgagcgcaaacacacagcatcccaacaatggcaaagagagaagcacccagaa

SEQ ID NO: 452461 - DNA, 2046 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacaggatactgatcccctagaacccaagagtccaggtacctcttcccttcctttctcctctagggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccacctcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452462 - DNA, 1959 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagcccccttgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcacatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacaggatactgatcccctagaacccaagagtccaggtacctcttcccttcctttctcctctagggcccaccagctctgagcagatcatgaagacaggggcccttttgcttcaggggtgagtttgaggtctgattattgtggcacagatttgaggagtgacaccccgttctgattctgcaccctcactccatccccactctagtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452463 - DNA, 1355 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggctggcgtgaaatggcgtgatctgggctcactgcaacctctgcctcctgggttcaagcgattcacctgcctcagcatcccaaggagctgggattacaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgcagaggatgattgccgccgtggacacagactccccccgagaggtctttttccgagtggcagctgacatgttttctgacggcaacttcaactggggccgggttgtcgcccctttctacttt

SEQ ID NO: 452464 - DNA, 1374 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcaggggtgagtttgaggtctgattattgtggcacagatttgaggagtgacaccccgttctgattctgcaccctcactccatccccactctagtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacaca

SEQ ID NO: 452465 - DNA, 1777 bp, Homo sapiens
cggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcaggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacaaaaaaaaaaaaaaaaaaaaaaaaaaaaaaaaaaaaaaaaaaaaaatcaaaaaaaaaaaaaaaaaaacaaaaaaaaaacaaaaagagaggcggggcgcgcccgcctctccatccatcttctcctcacgccagggggcacccaactcgcctcccccccccaccctctttttttttgccacgacaggggcgcccccaacatgagggcggtcctctctattctaattccatcaccagagcggcaccgcggccagcgtgatccaaacacagaacgtagagtggcgagacagaccaacgacgacgcgcgcgcaggaggaccgtctggggagggaaggccaccaaaaataacagagcctggagcgacggcaaaacaccagcgcgggaaccacacaccccccacgcagaagtagaaacagcccagcgaaggcagtacacaacacaaacaaacgcgagttgatccgggagacaacccacaggtacgacagccgcacggcgcgaagcgaaaaccggccccacagacaaagtacacatacgaaacaataacaaccccgcgggatcggagcgggaaccacacgcgccgtgacccgacgccaagccacgcgacaacacgtcgacacgaccaccacgaccgcgacacgccc

SEQ ID NO: 452466 - DNA, 1542 bp, Homo sapiens
tgtcgatttccggggtaagatggctgcagtccgtatgctgagaacctggagcaggaatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaagtattacttctcatggaaatcttaagatcaacatgtcagtgaggaaatcacctagaatttagacattttctttggaactttggctggtctgtatcattattttgaaaatctccttgatgtttacaagctacctgactactttatcttttattctttaatgattagggtgacctagttccacatggcctgaaggtaacattggcagtaatgtgactaggtacatgtagacttgaaattaaactcagcataaataagagttctctctctccctccttttatacctcttattgtttcaaattctctatcctttctaagttaaaagtactaaaattgcattctttttctgttaaacagctgcttccttgggattactacagtttcctatccttaacgcttctgtggatgaaaactgccagaatataacatataaggttggctatggaaggagtaaaaatgttcttattattaatagaagatggggcaaatgtgcttgtagattagagacttctattgtacctcaaatagtgatcttttttagactagaattaaaggtatggggtaaaacattaaacttaagtctaatta

SEQ ID NO: 452467 - DNA, 277 bp, Homo sapiens
cttgtggtggaggacaaaggagagggagacagatagaaattacaacccagcatgagagatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtaagtgaatctgaaaaaa

SEQ ID NO: 452468 - DNA, 3324 bp, Homo sapiens
aaatgaataatggtgtaatggttctcctggggctgtcacattttataggtcagagtgtgacttcttaatatggtgctgatgtttttgtgtcaatggcttgaaactgggattacaggcatgagccactgcgcctagcccaaaaaatcttttaaaaattatttttaaattatttcttttaaatcactaccaatctggtaaaaatgagttttggtagtggtttctagatggcagtgaaggttgatcctttctttgctgttagcttattcattaaaagccctactgtacaattttttattttttaggcttctcataacattgggatagcaatggatactgagcagggtttgattgtccctaatgtgaaaaatgttcagatctgctctatatttgacatcgccactgaactgaaccgcctccagaaattgggctctgtgggtcagctcagcaccactgatcttacaggaggaacatttactctttccaacattggatcaattggtggtacctttgccaaaccagtgataatgccacctgaagtagccattggggcccttggatcaattaaggccattccccgatttaaccagaaaggagaagtatataaggcacagataatgaatgtgagctggtcagctgatcacagagttattgatggtgctacaatgtcacgcttctccaatttgtggaaatcctatttagaaaacccagcttttatgctactagatctgaaatgaagactgataagacattcttgaactttttgagcttccaaagagtatgtaaaccctagctgtgccagcacatgttcatctttacaatttatattgtaaatgatttgtatcgtatgattaaggatctaaggcacaatatttgtcactgttctattagactttttactgaaaatgaataatggtgtaatggttctcctggggctgtcacattttataggtcagagtgtgacttcttaatatggtgctgatgtttttgtgtcaatggcttgaaactggcaagattaacaaaattaggccgggcatggtggctcacgcctgtaatcccagcactttgggaggcccaggtgggcggatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctgggaggtggaggttgcagtgagctgagatcgtgctattgcactccagcctgggcgacagagcaagacgccatctcaaaaacaaaaaaacaaaattcatgttactaaaagacaggtagccatatacagacagtatatgccctattttttttaactgactcttaatgaaactttaattttacttaattaagaaatggaatttatatacaaaaatattttccatttccgttattatgctaattgttgtatgaaataagtgcaattatacttctcttttgagatatccaagagtatattcttgctctgtatagagaatatcatctgatagtgtcttatttatattaattaatgtctttgaaaagggaaaagtataaactggccttaaaattgtccaattatagttttataaccagtctattaaaggtgtttgtttaaaatggatatagttttagatttgtggtaatgctttggtattttcttggggaagaccttcacctttgcaaacttccctcatgtaaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtaaataagaggagaaggaagagtctaatagtaattatggatataaaaaataagaaattttgtatagaaatgaaggtttcataatgatcattttgttaaaggtctactttaatcagaaatagcaacgagatgaatgtatccaacatttcaatttgcattcggaaatccatgttgtttctaatattgtccagttgaaaactgtatgccaaaattagttgtttaagtgaagttttgtgacagaaaaaaggttgttttaatatctacttggtttttctcaaaatggaaataattttaaaatcaggaaagaataaatcagccaggtgtgatgacttgtaactgtaatcccagttataggggaggctgaagcaggaggatcacttgaggccaggagtttgagaccagcctgggcaacatagtgagatcccatctcaaaaaacattatttttaaaattagcctggtggctcacgcctgtaatcccagcactttgggaggccgaggtggccagatcacctgaggtcaggagttcgagaccaccctggccaacatggtgaaaccccatctctacagttttgtaaaaatacaaaaaattacctgggcctggtggcacacgcctgtagtcccagctacttgggaggctgaggcaggagaattgcttgagcccaagaggtggaggttacagtgagcagagatcacaccactgcactccagcctgggtggcagagcaacacttcgtctcagaaaaaaaaaaaaaaaaaaaaccaaaaagccaagtgtggtggtgtgcacctatagtcccagctactcaggaagctgagacaagaggatcaattgagcccaggagttcaaagctgtagtgagctgtcattgtgccactatcctccagtatgggtgacagagtgagacctggtctctaaaaaataaaataaaataaaaaaaacaggtcaaataaatgctgttgttgtaaaatttcagataatacaaagagttaaccaataaaagaaaaagtcattcataatcttaccactattaacattttgatgtatctatctgtatgtatggctattcttttttgttaaaacatgatcatagcatatctactattttattatttgatttttaaaatttaacattatattatgggtaaccttacatgtcaataaacaattccacattgtcatgctttaaatggctgcataggctgggtgtggtggctcacgcctgtaatcctaccactttgggaggccaaggcaggtagatcacaaggtcaggagttcgagaccagcctggccaatatggtgaaacctcatctctattgaaaatacaaaaatcagccaggcacggtggcaggcgcctgtagtccacctactcgggaggctgaggcaggagaactgcttgaacccagcggcagaggttgcagtgagccaaga

SEQ ID NO: 452469 - DNA, 185 bp, Homo sapiens
tttggcattaaaatatatcattttttagattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttc

SEQ ID NO: 452470 - DNA, 4058 bp, Homo sapiens
tgtcgatttccggggtaagatggctgcagtccgtatgctgagaacctggagcaggaatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaaggctgcttccttgggattactacagtttcctatccttaacgcttctgtggatgaaaactgccagaatataacatataaggcttctcataacattgggatagcaatggatactgagcagggtttgattgtccctaatgtgaaaaatgttcagatctgctctatatttgacatcgccactgaactgaaccgcctccagaaattgggctctgtgggtcagctcagcaccactgatcttacaggaggaacatttactctttccaacattggatcaattggtggtacctttgccaaaccagtgataatgccacctgaagtagccattggggcccttggatcaattaaggccattccccgatttaaccagaaaggagaagtatataaggcacagataatgaatgtgagctggtcagctgatcacagagttattgatggtgctacaatgtcacgcttctccaatttgtggaaatcctatttagaaaacccagcttttatgctactagatctgaaatgaagactgataagacattcttgaactttttgagcttccaaagagtatgtaaaccctagctgtgccagcacatgttcatctttacaatttatattgtaaatgatttgtatcgtatgattaaggatctaaggcacaatatttgtcactgttctattagactttttactgaaaatgaataatggtgtaatggttctcctggggctgtcacattttataggtcagagtgtgacttcttaatatggtgctgatgtttttgtgtcaatggcttgaaactggcaagattaacaaaattaggccgggcatggtggctcacgcctgtaatcccagcactttgggaggcccaggtgggcggatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctgggaggtggaggttgcagtgagctgagatcgtgctattgcactccagcctgggcgacagagcaagacgccatctcaaaaacaaaaaaacaaaattcatgttactaaaagacaggtagccatatacagacagtatatgccctattttttttaactgactcttaatgaaactttaattttacttaattaagaaatggaatttatatacaaaaatattttccatttccgttattatgctaattgttgtatgaaataagtgcaattatacttctcttttgagatatccaagagtatattcttgctctgtatagagaatatcatctgatagtgtcttatttatattaattaatgtctttgaaaagggaaaagtataaactggccttaaaattgtccaattatagttttataaccagtctattaaaggtgtttgtttaaaatggatatagttttagatttgtggtaatgctttggtattttcttggggaagaccttcacctttgcaaacttccctcatgtaaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtaaataagaggagaaggaagagtctaatagtaattatggatataaaaaataagaaattttgtatagaaatgaaggtttcataatgatcattttgttaaaggtctactttaatcagaaatagcaacgagatgaatgtatccaacatttcaatttgcattcggaaatccatgttgtttctaatattgtccagttgaaaactgtatgccaaaattagttgtttaagtgaagttttgtgacagaaaaaaggttgttttaatatctacttggtttttctcaaaatggaaataattttaaaatcaggaaagaataaatcagccaggtgtgatgacttgtaactgtaatcccagttataggggaggctgaagcaggaggatcacttgaggccaggagtttgagaccagcctgggcaacatagtgagatcccatctcaaaaaacattatttttaaaattagcctggtggctcacgcctgtaatcccagcactttgggaggccgaggtggccagatcacctgaggtcaggagttcgagaccaccctggccaacatggtgaaaccccatctctacagttttgtaaaaatacaaaaaattacctgggcctggtggcacacgcctgtagtcccagctacttgggaggctgaggcaggagaattgcttgagcccaagaggtggaggttacagtgagcagagatcacaccactgcactccagcctgggtggcagagcaacacttcgtctcagaaaaaaaaaaaaaaaaaaaaccaaaaagccaagtgtggtggtgtgcacctatagtcccagctactcaggaagctgagacaagaggatcaattgagcccaggagttcaaagctgtagtgagctgtcattgtgccactatcctccagtatgggtgacagagtgagacctggtctctaaaaaataaaataaaataaaaaaaacaggtcaaataaatgctgttgttgtaaaatttcagataatacaaagagttaaccaataaaagaaaaagtcattcataatcttaccactattaacattttgatgtatctatctgtatgtatggctattcttttttgttaaaacatgatcatagcatatctactattttattatttgatttttaaaatttaacattatattatgggtaaccttacatgtcaataaacaattccacattgtcatgctttaaatggctgcataggctgggtgtggtggctcacgcctgtaatcctaccactttgggaggccaaggcaggtagatcacaaggtcaggagttcgagaccagcctggccaatatggtgaaacctcatctctattgaaaatacaaaaatcagccaggcacggtggcaggcgcctgtagtccacctactcgggaggctgaggcaggagaactgcttgaacccagcggcagaggttgcagtgagccaaga

SEQ ID NO: 452471 - DNA, 3868 bp, Homo sapiens
  misc_feature (48)..(48): n is a, c, g, or t
ttctagtcgagcccttggtgatcggccgaggcagaactgccagcaggnatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatgattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaaggctgcttccttgggattactacagtttcctatccttaacgcttctgtggatgaaaactgccagaatataacatataaggcttctcataacattgggatagcaatggatactgagcagggtttgattgtccctaatgtgaaaaatgttcagatctgctctatatttgacatcgccactgaactgaaccgcctccagaaattgggctctgtgggtcagctcagcaccactgatcttacaggaggaacatttactctttccaacattggatcaattggtggtacctttgccaaaccagtgataatgccacctgaagtagccattggggcccttggatcaattaaggccattccccgatttaaccagaaaggagaagtatataaggcacagataatgaatgtgagctggtcagctgatcacagagttattgatggtgctacaatgtcacgcttctccaatttgtggaaatcctatttagaaaacccagcttttatgctactagatctgaaatgaagactgataagacattcttgaactttttgagcttccaaagagtatgtaaaccctagctgtgccagcacatgttcatctttacaatttatattgtaaatgatttgtatcgtatgattaaggatctaaggcacaatatttgtcactgttctattagactttttactgaaaatgaataatggtgtaatggttctcctggggctgtcacattttataggtcagagtgtgacttcttaatatggtgctgatgtttttgtgtcaatggcttgaaactggcaagattaacaaaattaggccgggcatggtggctcacgcctgtaatcccagcactttgggaggcccaggtgggcggatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctgggaggtggaggttgcagtgagctgagatcgtgctattgcactccagcctgggcgacagagcaagacgccatctcaaaaacaaaaaaacaaaattcatgttactaaaagacaggtagccatatacagacagtatatgccctattttttttaactgactcttaatgaaactttaattttacttaattaagaaatggaatttatatacaaaaatattttccatttccgttattatgctaattgttgtatgaaataagtgcaattatacttctcttttgagatatccaagagtatattcttgctctgtatagagaatatcatctgatagtgtcttatttatattaattaatgtctttgaaaagggaaaagtataaactggccttaaaattgtccaattatagttttataaccagtctattaaaggtgtttgtttaaaatggatatagttttagatttgtggtaatgctttggtattttcttggggaagaccttcacctttgcaaacttccctcatgtaaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtaaataagaggagaaggaagagtctaatagtaattatggatataaaaaataagaaattttgtatagaaatgaaggtttcataatgatcattttgttaaaggtctactttaatcagaaatagcaacgagatgaatgtatccaacatttcaatttgcattcggaaatccatgttgtttctaatattgtccagttgaaaactgtatgccaaaattagttgtttaagtgaagttttgtgacagaaaaaaggttgttttaatatctacttggtttttctcaaaatggaaataattttaaaatcaggaaagaataaatcagccaggtgtgatgacttgtaactgtaatcccagttataggggaggctgaagcaggaggatcacttgaggccaggagtttgagaccagcctgggcaacatagtgagatcccatctcaaaaaacattatttttaaaattagcctggtggctcacgcctgtaatcccagcactttgggaggccgaggtggccagatcacctgaggtcaggagttcgagaccaccctggccaacatggtgaaaccccatctctacagttttgtaaaaatacaaaaaattacctgggcctggtggcacacgcctgtagtcccagctacttgggaggctgaggcaggagaattgcttgagcccaagaggtggaggttacagtgagcagagatcacaccactgcactccagcctgggtggcagagcaacacttcgtctcagaaaaaaaaaaaaaaaaaaaaccaaaaagccaagtgtggtggtgtgcacctatagtcccagctactcaggaagctgagacaagaggatcaattgagcccaggagttcaaagctgtagtgagctgtcattgtgccactatcctccagtatgggtgacagagtgagacctggtctctaaaaaataaaataaaataaaaaaaacaggtcaaataaatgctgttgttgtaaaatttcagataatacaaagagttaaccaataaaagaaaaagtcattcataatcttaccactattaacattttgatgtatctatctgtatgtatggctattcttttttgttaaaacatgatcatagcatatctactattttattatttgatttttaaaatttaacattatattatgggtaaccttacatgtcaataaacaattccacattgtcatgctttaaatggctgcataggctgggtgtggtggctcacgcctgtaatcctaccactttgggaggccaaggcaggtagatcacaaggtcaggagttcgagaccagcctggccaatatggtgaaacctcatctctattgaaaatacaaaaatcagccaggcacggtggcaggcgcctgtagtccacctactcgggaggctgaggcaggagaactgcttgaacccagcggcagaggttgcagtgagccaaga

SEQ ID NO: 452472 - DNA, 1593 bp, Homo sapiens
tgtcgatttccggggtaagatggctgcagtccgtatgctgagaacctggagcaggaatgcggggaagctgatttgtgttcgctattttcaaacatgtggtaatgttcatgttttgaagccaaattatgtgtgtttctttggttatccttcattcaagtatagtcatccacatcacttcctgaaaacaactgctgctctccgtggacaggttgttcagttcaagctctcagacattggagaagggattagagaagtaactgttaaagaatggtatgtaaaagaaggagatacagtgtctcagtttgatagcatctgtgaagttcaaagtgataaagcttctgttaccatcactagtcgttatgatggagtcattaaaaaactctattataatctagacgatattgcctatgtggggaagccattagtagacatagaaacggaagctttaaaagattcagaagaagatgttgttgaaactcctgcagtgtctcatgatgaacatacacaccaagagataaagggccgaaaaacactggcaactcctgcagttcgccgtctggcaatggaaaacaatattaagctgagtgaagttgttggctcaggaaaagatggcagaatacttaaagaagatatcctcaactatttggaaaagcagacaggagctatattgcctccttcacccaaagttgaaattatgccacctccaccaaagccaaaagacatgactgttcctatactagtatcaaaacctccggtattcacaggcaaagacaaaacagaacccataaaaggctttcaaaaagcaatggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaaggctgcttccttgggattactacagtttcctatccttaacgcttctgtggatgaaaactgccagaatataacatataaggcttctcataacattgggatagcaatggatactgagcagggtttgattgtccctaatgtgaaaaatgttcagatctgctctatatttgacatcgccactgaactgaaccgcctccagaaattgggctctgtgggtcagctcagcaccactgatcttacaggaggaacatttactctttccaacattggatcaattggtggtacctttgccaaaccagtgataatgccacctgaagtagccattggggcccttggatcaattaaggccattccccgatttaaccagaaaggagaagtatataaggcacagataatgaatgtgagctggtcagctgatcacagagttattgatggtgctacaatgtcacgcttctccaatttgtggaaatcctatttgccagattatgcacacaactgaagggatggtgtacctttaactttgggccccaaatgtacccagcgcgcggtatataagcaagtacaagctcatgacaggcgaacaaacaatacttaaatcaccaaatgaatgctcgcttcaataaggcttatgtgttgatc

SEQ ID NO: 452473 - DNA, 4142 bp, Homo sapiens
cccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctga

SEQ ID NO: 452474 - DNA, 2278 bp, Homo sapiens
tgaaacatcaccacacagtaccaccatccgtcacacctaaagcattggacaggagtcctccgtgtcctgaaatgttcactcgggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctga

SEQ ID NO: 452475 - DNA, 3113 bp, Homo sapiens
cccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagatgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctga

SEQ ID NO: 452476 - DNA, 943 bp, Homo sapiens
cgcttggggctttcgagtttccagctgtggtggtctgggctctccctctgtatcgcctggggctttcgagttgccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctga

SEQ ID NO: 452477 - DNA, 2485 bp, Homo sapiens
cccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccacactgtgcccctcattgttactgccttgtgagataaaaactgattaaacctttgtggctgtggttggctga

SEQ ID NO: 452478 - DNA, 1129 bp, Homo sapiens
cccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcaggtaagttgccccatccaggaggagctctctcggacccgttggcttggttggaggccacgtggtgaggccagggtcaggtaaattggcctcagggtaaattggctttgagtggatgggccagtgtgttcttcagattgaaatcttgccactagtggggggaaagggggaaaatgtatgttttctttcacacaagggacgtgtcatcattatcacgaagaccaatcttgccagcatggagtaagctggtgctgggaggggctcccgatatgctgaccactttccagggcacaagagccagtgattggcagacagcccaaaggatggaaagatgatttctgaacgtggccctgcttgcagcaggcagtttcaactctgatacagtcagcagattgccttgaaataacagggctttgagggtcttcagccctctccacctcccggcctttgtgacatgtgatgggtcaccactgtcttcctgtgaggtcccttttcatcaaatgcaaaactgggcttcctacgctcaagggaagctccagcctcttttgtccccatctcctgacagccccaggggtggccattcaccgc

SEQ ID NO: 452479 - DNA, 519 bp, Homo sapiens
catcttcgaggtcccagccaaggtgctccatttcacttcctgcccctccggccgtctgtttttcaaaagctctgcccaggatttcacagtgagccaagttctgagtggccctctccactaggaatgtggcatcagccactatgtcctagcagatctgctagtgatgacatttctttaacagtcaaaggagcaggtgggattggctttagactgacttcacatctctgctcgagcaggtccctgctcaagggcctcgtaaccacccatggccactggctgctgccctggaccgtgcaggccttgagctcccagggccatcctggggcaggggctgtgccaggcaccaacatggcttgttctccaaggtggcccacctggggcgctggctgctgactcctggcccatcgcctcacaggtacaatgccagggagtactacgaccacctgcccgagctgaagcaggccgtggaccagatcagcagtggctttttttctcccaaggagccagactgcttcaagg

SEQ ID NO: 452480 - DNA, 4252 bp, Homo sapiens
  misc_feature (4215)..(4215): n is a, c, g, or t
  misc_feature (4240)..(4240): n is a, c, g, or t
cccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctgaaaaaaaaaaacaaaaaaacttatcgatacccgtccaccctcaatgatgatgatgaatgatgtccaaccccggnaatttccggaaccggtaccttgcanggcgttacccaa

SEQ ID NO: 452481 - DNA, 3212 bp, Homo sapiens
cccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctga

SEQ ID NO: 452482 - DNA, 2809 bp, Homo sapiens
cccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccacactgtgcccctcattgttactgccttgtgagataaaaactgattaaacctttgtggctgtggttggctga

SEQ ID NO: 452483 - DNA, 1142 bp, Homo sapiens
cccgcagagccgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggactggtgaggagagcaggggtcccagggaggcattggggtgctgggtaatgacctcggccctgggtttctcctctccctgcgggacaggagcctcagaaagggccaagggcaaggtgggcttggggggctctgggaatctcagctctagccctgtatggccaggatctgctgtctccgtccctcctgggtcccagcagctgtcctgcagctgtcagcaggagggcctggctttaataaagagtggacaaactg

SEQ ID NO: 452484 - DNA, 217 bp, Homo sapiens
gctaaaaaccttcaccctctccttccaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaaggtaaccctggaagcctgtgttggacagaaaactcactcctgccgggg

SEQ ID NO: 452485 - DNA, 1348 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactac

SEQ ID NO: 452486 - DNA, 800 bp, Homo sapiens
gaggttgcgcagtctacacaccaagacaagggcattcctctgcgggagtaaagggtaccatgtatctttctcaagtctttgaaaatgattatttcctgtgctttttttttgcagagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactac

SEQ ID NO: 452487 - DNA, 769 bp, Homo sapiens
gaggttgcgcagtctacacaccaagacaagggcattcctctgcgggagtaaagggtaccatgtatctttctcaagtctttgaaaatgattatttcctgtgctttttttttgcagagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcgg

SEQ ID NO: 452488 - DNA, 1683 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggaaaaaaaaaaaaaaaaaaaaaaaaaaaaaaaaaaaaaagggcgcggcgcgcgcgcccggggcccccgagagaaagcgcttccaaagaccatccgggggggcgcgcgcggggcgcccagaagggaaaggggaacaggggccaaaaccgcggggtcccaaaggagagaacccggggccagagagaaaagggcgcggggagattctctctcacccaaaaaaaaacgcccgcggggggaaaccgagagcggttcgcggaaaaaaatcccaagaggggagttccgagggggccacaaagggggatcctaacaaaaagggggggcccaggggaagcccggaatatccaaataagccccgcccgggggcagac

SEQ ID NO: 452489 - DNA, 1274 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttaaaaaaaaaaaaaaaaaaaaaaaaaaaaaaaaaaaaaagggcgcggcgcgcgcgcccggggcccccgagagaaagcgcttccaaagaccatccgggggggcgcgcgcggggcgcccagaagggaaaggggaacaggggccaaaaccgcggggtcccaaaggagagaacccggggccagagagaaaagggcgcggggagattctctctcacccaaaaaaaaacgcccgcggggggaaaccgagagcggttcgcggaaaaaaatcccaagaggggagttccgagggggccacaaagggggatcctaacaaaaagggggggcccaggggaagcccggaatatccaaataagccccgcccgggggcagac

SEQ ID NO: 452490 - DNA, 1300 bp, Homo sapiens
atcgttattcagcatatcccactcacgacgtctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactac

SEQ ID NO: 452491 - DNA, 1282 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactac

SEQ ID NO: 452492 - DNA, 1260 bp, Homo sapiens
tcggctaggagaggccgggtgtgaatcggccgaggaggagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacaggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactac

SEQ ID NO: 452493 - DNA, 643 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacaggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcgg

SEQ ID NO: 452494 - DNA, 479 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagtcgacctgtcacgtgtcgctatccaaatatctcagtcaacaaccgaccttcacgttcgctaggtccgcct

SEQ ID NO: 452495 - DNA, 878 bp, Homo sapiens
  misc_feature (671)..(671): n is a, c, g, or t
  misc_feature (676)..(676): n is a, c, g, or t
  misc_feature (684)..(684): n is a, c, g, or t
  misc_feature (687)..(687): n is a, c, g, or t
  misc_feature (692)..(692): n is a, c, g, or t
  misc_feature (697)..(697): n is a, c, g, or t
  misc_feature (705)..(705): n is a, c, g, or t
  misc_feature (707)..(707): n is a, c, g, or t
  misc_feature (715)..(715): n is a, c, g, or t
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctgtggngttgnatctatanggngatcntcatnaggttccnancctggaancggtggttttagcgaagatgaggccaagtcggacctgttggggatccacggagttgggtaagcctgagggactccgacccggggggacctttgaaaacagtttgtcttcgccgagggttagagccgaccgcaacaggagttataccctttggaccagagggtg

SEQ ID NO: 452496 - DNA, 1317 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcgg

SEQ ID NO: 452497 - DNA, 1350 bp, Homo sapiens
tcggctaggagaggccgggtgtgaatcggccgaggaggagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactac

SEQ ID NO: 452498 - DNA, 1442 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaagtagagacggggtttcaccgtgttggccaggatggtctcaatctcttgaccttgtgatccgcctacctcgtcctccccaagtgctgggattacaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccagggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactac

SEQ ID NO: 452499 - DNA, 1258 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacaggtttgtaccagttgctggagccccgaatgattgttcgttgcaggaaacaagatttccctctggtaaaggctgcagtgcagaaggcaattcctatgtacaaaattgccaccaaaaacgatgttgatgtccaaattgaccaggagtcctacctgcctgaagacatagctggtggagttgagatctataatggagatcgtaaaataaaggtttccaacaccctggaaagccggctggatctcatagcccagcagatgatgccagaagtccggggagccttgtttggtgcaaatgccaacaggaagtttttggactaagccttcaggaggtggagctcgtcgtcagctctcctgctgtgatgtggaagcttctgatatttgaagaaacacgaatgtctctgtagcttcctcttcactgccccagtattgctctgtatttatcagcgatgcccctctgtcactcatgccttgcctaattgttcacaatggtggaaagcttcatgtaatatgatcaggacccacctccagttcttctgaaagtgtgacagtgtccagccggttctgcagcactaggggagggggcagatggtggttgcatgggcttcctgggtctccactctccgtctggcctaaaggtgatgtatttggtgtttggccctgcagtccccactcttgaggcttaaggcgcatgtggcacaccactccttccagcagtagtcgctttactgttacctgtttaggcctagaagttttccctcatctgtaaatgtgatttaaaatctaagccatgaatatgctttatttattaaaagagttatgcggatttaatgtgatttctagtgtaaggcactac

SEQ ID NO: 452500 - DNA, 854 bp, Homo sapiens
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaattcagatgtccaatttgatgaatcaagcgagactcaaagtcctcagagcaagagatgaccttatcacagacctactaaatgaagcaaaacagagactcagcaaggtggtaaaagatacaaccaggtaccaagtgctgctggatggactggttctccaggtaccctcatagaccagatctactgttgatagccacagttctgagaaaatttagaatgcctattagagaccagctctattttttcctgctttctcatttctctagtttttttcctttcaccctttttttttcttttagcttttttactttcactcttgaccatatctaaaatgtgtgctgcataggaaaatagtaaatctgtctgcttggataagacttccaggcctactactcaattatgtagtcttacatgacttaagggtcaaatttgcttgcaatggctagctttaaattcccttaatttgattttgccactaaaatacttgctttagatttaggattcagaccaaacactg

SEQ ID NO: 452501 - DNA, 478 bp, Homo sapiens
  misc_feature (387)..(387): n is a, c, g, or t
  misc_feature (442)..(442): n is a, c, g, or t
  misc_feature (457)..(457): n is a, c, g, or t
gaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcagataaagcatatgatggctttcattgaacaagaagccaatgagaaagcagaagaaatagatgcaaaggcagaagaagagttcaacatagagaaaggtcggcttgtgcaaacccaaagactaaagattatggaatattatgagaagaaagagaaacagattgagcagcagaagaaaatgtagaaaagaagtagacataggagactccattttgttctgtactangaaaaaattctttttgcccttgggattgctgttaatcctataaccttaccccaancccggtgctctctgnaacatgtgctgtgtccctaag

SEQ ID NO: 452502 - DNA, 1556 bp, Homo sapiens
agtggctctactttcagaagaaagtgtctctcttcctgcttaaacctctgtctctgacggtccctgccaatcgctctggtcgaccccaacacactaggaggacagacacaggctccaaactccactaagtaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccatgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcacccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtcccttcttggagg

SEQ ID NO: 452503 - DNA, 656 bp, Homo sapiens
atgggtgcacctgctgtgtagctcaagtgtgatgggctctggagtgccccacttctgatctcaggctgctatctctccacaccagctgtgtctccctgctaaccacgctaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcgtgaggacacccccagctccatgtggtccccccaactcatggggcccttctgtgttccctccttcacccccatctcagagctgggggagcccaacgcatcctctcaaaacccaattttcccatcctgcctcccatcttgccactgccagccctttcccatcccccaccctccagagcccctcaccccacacccagcatccctgtcctccacactttcagcacctccatggcttatacccaagacctccatccccagctgggaggtggggtgcaggcaggtgggggcactgacaatcccccctctccactcctcttctctccccct

SEQ ID NO: 452504 - DNA, 1664 bp, Homo sapiens
atgggtgcacctgctgtgtagctcaagtgtgatgggctctggagtgccccacttctgatctcaggctgctatctctccacaccagctgtgtctccctgctaaccacgctagtgagtccagattgtagactaaacaaaatcagcaaatggcccctgagtgccaccaagtcccagatgctatcctgtgctggtaactaggatttgatggctcaccctaaccatcattaaatcccaaatcagccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccatgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtcccttcttggagg

SEQ ID NO: 452505 - DNA, 1619 bp, Homo sapiens
agtggctctactttcagaagaaagtgtctctcttcctgcttaaacctctgtctctgacggtccctgccaatcgctctggtcgaccccaacacactaggaggacagacacaggctccaaactccactaagtaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccatgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtcccttcttggagg

SEQ ID NO: 452506 - DNA, 1756 bp, Homo sapiens
atggttgcccgagctgtgttgttacaattgtaatggcgtctgtagtgctgatttctgatctcaccgctgctatctttccatgccacgctgctgtctcgctggctacagaagcgctagtgatctgctggattgtacgagtacacagagaaatcagtgacacactggccccgtgagtgccgagccacacgttaccagactcctagtctcatgtggctgttaatctagcgatatgactggttctagtcgcttaactcgagtcagttaaagtcgccatacatcatgccagagcgtgtgacttgtgcccgatgacttggactgagtagtcatgtaagttactgctccattcactcggagagatatccaaacgagtcaacgccaatcggcaggcagacgtgctccaatcattcgaagagatcagagggacgcttccgcaagcaggccgggtgtggccatcgcgtcgggcacttcagatctggtgcatgcctgggtgctggtgaccagccagctctgatcctcatcgggctgtctcgactctggattactcctgatggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggggagtttatctgggtggatgggagccatgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgagagtacaccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccacatttgtcccttcttggagg

SEQ ID NO: 452507 - DNA, 3038 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452508 - DNA, 3702 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagaagagcttttgcctgtcagttgtgtgtgtcccttatagtcccttcccccacagctcttgctgaaagagtttgccttgttttgttttgttgttttgtatttagccagaggatgccaaaattagtcttctcaaagctttgagtagagtaagtgtgggaataagccagtttttttttttctgtttctgtaacttaaatgaacgggtttttttcccttgtatgccacttgtcctaacatgtccttaaggtgtttaacctgcctctgacctggcttgcaatgcataggtgaggagaagcagagagcttgtcatatgcaagtcctgtcaagaaaacaggtgggcatggtggctcaggtctgtagtctttgggtctttgggaggccagggtgggaggatcacttgagctcaggagtttgagaccagcctagacaacatactacgaccctgtctatacaaaaaaaaacttctctaaattagccggatgtggtggtgcatgcctgtagtcccagctactcgggaggctgagtgaggcaggaggatcacttgagaccaggaggttgtggctgtagtgagtgatgatcatgccactgcacttcagcctggaccacagagcaagaccctgtgtaaaaaaataaaataaaaaacagattggatgtctttaaaaaatgt

SEQ ID NO: 452509 - DNA, 3035 bp, Homo sapiens
  misc_feature (48)..(48): n is a, c, g, or t
cgcgaatccaggtcccagaagcaggagatggccgagaagatggtcccngatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452510 - DNA, 3296 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagatggctctaaaaaaaaaaaaaaaacaacaaaaaaaaaactttttggggcgcgcgccttgggcccctctcgaaagaaagctctcttataacacaatcttgggttgggcggcgggggccccaagtttatgttatgtgtaaccttgggctcatacgtggctccccagagggagaactcgggcgcaagacactaggtgtgtggatttcctcccatataaaaaaccccggggggcaaccgagtgtttttgaaaaatctccgatg

SEQ ID NO: 452511 - DNA, 2895 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452512 - DNA, 3207 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcgacacagtaccacgacacagtgcaccacgacacagcactgtgtcgtggtagaatatcccatttctgagttttaagaactctgaaatgtgcaaagtacaaataagtactctcttgcattcctattttagtcaaaagatccaggctccaaattgcttaatacatctttgagtagtattgcagacaattttaattgaaaattatattcaaaatactgattccaattcctacatgaactgtaacccaattagtcaaccacgaca

SEQ ID NO: 452513 - DNA, 2261 bp, Homo sapiens
  misc_feature (48)..(48): n is a, c, g, or t
cgcgaatccaggtcccagaagcaggagatggccgagaagatggtcccngatagcgagggcggccgcgccggctccagggccatgaagcccccaggaggagaatcgagcaatctttttggaagtccagaagaagctactccttccagcaggctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452514 - DNA, 2280 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatccctataatggataactgccctgttctctccttccttgccctcttcttggaattggaagtatttttcaaagacagaggcaaaacaatcttcgttcaacatgccagcttgatgcacaatgaatccttgggatccggaagattttcatggcatattgcaaagagacattttattctgagtctggattaaccaagaacttccgtacaccctct

SEQ ID NO: 452515 - DNA, 1170 bp, Homo sapiens
ggagccgcctgccaagctcccttctacacctgcacactgggtctgcacaaggctgcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452516 - DNA, 858 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggtatggactgcattcagacgtgacagcgcagcagcgggtatgccaggtgctctttccaaaaaggctccaaggcagatgcgacatgtttttagggagaatcatggtgggtgccgtagattatcctggatgcaagcattagtcatcgagtttggaagttcccctgagtcacccaggaaacagtccagccttgtgctgactgaagccgtgggggaagctcttctgtgctggtggcggacgcccactgcagacgggctgtggcggctcctcactgcagtgctgcggggcgcggagaagcggtggggagcggaacgtgccgcagacgagctgggcccttgtccgtcttccactcttcctgtttcaccttgcagaggaaaagtgacagttcttttctgatgggcttttccccgcacagtcaaggtcctcggctggttacctgtggagattgtcagcacttgactgaagcgtagctgacgcctctgacccagt

SEQ ID NO: 452517 - DNA, 3061 bp, Homo sapiens
gcggccgcgccggctccaggaaatggcaactgctgacaggaagtttggcatccacctcccccagcctcctgagtggacaggggccctgggcaccacttcagagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452518 - DNA, 3094 bp, Homo sapiens
  misc_feature (3070)..(3070): n is a, c, g, or t
  misc_feature (3078)..(3078): n is a, c, g, or t
  misc_feature (3081)..(3081): n is a, c, g, or t
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagaaaaaaatcgaggcctggatcgacgatatccanttaatcgnggntgtacagcaagca

SEQ ID NO: 452519 - DNA, 3096 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcagaaaaaaaaacaaagcttgtgcatgtaaacgaaaaaaaaaaagtctgcgcggccgcgaat

SEQ ID NO: 452520 - DNA, 2753 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaaaaaaccaaataataatagttatccgtcttctacttcatggaagattgttttggtgccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452521 - DNA, 2984 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggatcatgttttcttatgtgaaggagaagaaccaaaatcggatcttaaagctgcaaggagcatcccggctggagcagagccaggtgagaaaggcagcgccagaaaagcaggccccgccaaggagcaggagcccatgcccacagtcgacagccatgagccccggctggggccgcggcctcgctctcacaacaaggtcctgaacccaccgggaggcaaatccagcatctccttctactaagagaagccactgctccacccggagccagaccagaaactcaagagatagggtagccatgttttcatttccttttgcccaaatgagcggggtgggaagagggttagtcttatgtgagcctggctgctcagcgtctcctggccgtcatgacagctgcttggagacccgtgccttccagatggctgggagatgcctctgtggggatgaaatggggcacccctggccatcactcatgtgtagtccaggtttgagaggaactggaaggggggtgagggtggggaggtggggcagggcatggtccttggatcaacagcccgccagctgattggatgtctaggaatgactgaaagaaaccaaaacagcctgtccactgctgctgtgggatggaggaggcgtaagcagaaacactaacagtatattgacctcttagcagaaccgcttccattctggagatcacggctgctaaatccagcatccccacttcattttacccccagcatattgttctgtagtcttttcttgaaacatcttgattgcttttcctcggcagctttcaagccctgaccctctgaagtgcccagttcctgccatctgaaacctcggcctgatctgatctcatgttggaatctgcctgtctttcacacagggctggtcttggtcctttacatgccagttttgcttgtgaattcttgcttttttcctctcatcagccttaagtttaggcgtttgttgttctccagtgatgtagacagttcccttcacaagtcacagttcttcccataaatgaggcccgctgacctctgcgggactttaaaaatctattcagatatttccgagtaagtggcttgtttaaattcttcctgtgtctttctttattccttaattggttggtggaaagaagagatgcttgggaaccttgggttcttaggtttggattctttaataatatctaaaaagctaaattttaaataccagctttacataaatgattgttgactctggtctgtttctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcaggcccagttctcatgctgcccttgggtgggcatctgttaacagaggagaacgtctgggtggcggcagcagctttgctctgagtgcctacaaagctaatgcttggtgctagaaacatcatcattattaaacttcagaaaagcagcagccatgttcagtcaggctcatgctgcctcactgcttaagtgcctgcaggagccgcctgccaagctccccttcctacacctggcacactggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452522 - DNA, 1084 bp, Homo sapiens
agcgggcgcggcgagctgagggtggcggcggtcgacatgttccaggtcccggatagcgagggcggccgcgccggctccagggccatgaagcccccaggaggagaatcgagcaatctttttggaagtccagaagaagctactccttccagcaggcctaataggatggcatctaatatttttggaccaacagaagaacctcagaacatacccaagaggacaaatcccccagtggggtctgcacaaggctttgtcaaccaaagacagcttcccccttttgattgcctgtagactttggagccaagaaacactctgtgtgactctacacacacttcaggtggtttgtgcttcaaagtcattgatgcaacttgaaaggaaacagtttaatggtggaaatgaactaccatttataacttctgtttttttattgagaaaatgattcacgaattccaaatcagattgccaggaagaaataggacgtgacggtactgggccctgtgattctcccagcccttgcagtccgctaggtgagaggaaaagctctttacttccgcccctggcagggacttctgggttatgggagaaaccagagatgggaatgaggaaaatatgaactacagcagaagcccctgggcagctgtgatggagcccctgacattactcttcttgcatctgtcctgccttctttccctctgcgaggcagtggggtgggattcagagtgcttagtctgctcactgggagaagaagagttcctgcgcatgcaagccctgctgtgtggctgtcgtttacatttgggaggtgtcctgtatgtctgtacgttggggactgcctgtatttggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacatcacaatgtcattttgataggagcgttttgttatttttacaaggcagaatggggtgtaacagttgaattaaacttagcaatcacgtgctcaga

SEQ ID NO: 452523 - DNA, 2707 bp, Homo sapiens
ggcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452524 - DNA, 3234 bp, Homo sapiens
gacattggtcattcaggttttatttatgacaacttcttagaacacacacatccaatctaggaacagaaatgtacaacatggggcttaaataactttcatacactatgtacagccatcggcagaggtacaaaacatatatacaccttgtgctagtcacatcatggaggacagcaggagcctaatgaagcctgcagcctgggcaggacatgattgctagaaaagagttggtgggcagggcagggccctgattcatctcaggggtcttctctgatcctcggctctttgtggaggagtttctatttcctacttccctgcaaggccctcaggacatggttcacaggactgaactagatgtgataggcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacaaaaatgacaaacacacaaaaaaaaacatttttggggggcacatcaccctcgaaaagagttttgtgaacccattttgtgtggggccgcggccccaatagtgtagtgacagagttggccaagaggggtacaagagaagaatcgtggcatgactagtgtgggattctcacccattaaaaagccgcgcggaaccggatgtttaggaaaaacatccgaggtggattcggaggcaacagggattcatcacgggggtcagaggaaccctattaaatc

SEQ ID NO: 452525 - DNA, 2807 bp, Homo sapiens
aggaagtccctgaggaccgcagcagtgcctttgccgctgttgcagaaggagaaggcttgcagtcgagccccggggcctggggacggtccttcctctgccagcccccgccctccccactcaggcgcacacctccctcactgacgcattttgccgcacaagctgtaacatggcggcagcgactgcggcctgaactctagggagccgggttgatttttaaagcttcaaaatcctaagactcagcactgttgcggggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452526 - DNA, 2654 bp, Homo sapiens
ggcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452527 - DNA, 2463 bp, Homo sapiens
ggcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452528 - DNA, 2749 bp, Homo sapiens
aggaagtccctgaggaccgcagcagtgcctttgccgctgttgcagaaggagaaggcttgcagtcgagccccggggcctggggacggtccttcctctgccagcccccgccctccccactcaggcgcacacctccctcactgacgcattttgccgcacaagctgtaacatggcggcagcgactgcggcctgaactctagggagccgggttgatttttaaagcttcaaaatcctaagactcagcactgttgcggggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacagtcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452529 - DNA, 2118 bp, Homo sapiens
tcaacgctttatacttccgaacaactcctctttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452530 - DNA, 2559 bp, Homo sapiens
taccctttttaaagttactgcttccttaactgaaataaaatttcaatttaaaatgactttttgtagagtccccaaaacattctattcatcatgggcaattgacttccctctgttatgagtctcctcttgagctaaatttcttaattattagaagactgcttgggcactgaaatataagcccatgccagtgaaatccatttcttatctctccatgttgctgtaaagcagtttttctgttatttccctgcactagttctgccaatcttgataataagagggaaagtggaaaactacaagattagaacatgggactcttcattgttattctgtgcttttaaaaaaaattcttattcagatgtttgttaacattagtttagcattttagactcacctattttttaaagttctttggattaatagataaaactttgaccagtgaattctggagatctggactctaatcctgagtcttgactcctttcctgtacttcccagttcacatagctggatgatctaagtgctaaatactgaacttagtgagaatctgcagaaaatttaaatctccttccacaaagtttgtctaaaaattgttgatcaaaacctttttgtttttattaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452531 - DNA, 1201 bp, Homo sapiens
ggcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgatacattactcagctgtgaaattacaatacacggagccgttccactagggc

SEQ ID NO: 452532 - DNA, 1452 bp, Homo sapiens
agttcgacggagaaactctccacagaacatctgtgttgttaactaagctttccaacaggtataaaaatcatctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452533 - DNA, 290 bp, Homo sapiens
atatcattttagctaataatatctacagttcttttcctaataacatttccccaattctttttcttattttttaggagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaa

SEQ ID NO: 452534 - DNA, 597 bp, Homo sapiens
ggcgggcggatcacgatgtcaggaaattgagaccatcctggctaacacggtgaaatgccgtctctactaaaaatacaaaaattagctgggcgtggtgatgggcgcctgtagtcccagctactcaggaggctgaggcaggagaatggcgtgaacccaggaggtggagcttaacagtgagccgagattgggccactgcactccagcctgggcaacagagcgagactccatctcaaaaaaaaagatgagaggggaaattgattcatatttgattctcttctttcataacctaactttattatctaagtaagttgtgtgtggcactaaataatacatcagatatgaatagaagtgaagatgaaatttttttggaggttatatctataatgtaactgaaaactttacttctctatagacgagagtttcgctgttaaacacaacaaagaatttctcttgtcaatggccaacagagggaaggatacaaatggttcacagttcttcatgtaagtatttattatctgatgatttaaaacatcccatttttgggccgggcacggtggctcatgcctgtaatcccaggactttgggaggctgaggcgg

SEQ ID NO: 452535 - DNA, 2964 bp, Homo sapiens
gacattggtcattcaggttttatttatgacaacttcttagaacacacacatccaatctaggaacagaaatgtacaacatggggcttaaataactttcatacactatgtacagccatcggcagaggtacaaaacatatatacaccttgtgctagtcacatcatggaggacagcaggagcctaatgaagcctgcagcctgggcaggacatgattgctagaaaagagttggtgggcagggcagggccctgattcatctcaggggtcttctctgatcctcggctctttgtggaggagtttctatttcctacttccctgcaaggccctcaggacatggttcacaggactgaactagatgtgataggcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452536 - DNA, 4409 bp, Homo sapiens
gacattggtcattcaggttttatttatgacaacttcttagaacacacacatccaatctaggaacagaaatgtacaacatggggcttaaataactttcatacactatgtacagccatcggcagaggtacaaaacatatatacaccttgtgctagtcacatcatggaggacagcaggagcctaatgaagcctgcagcctgggcaggacatgattgctagaaaagagttggtgggcagggcagggccctgattcatctcaggggtcttctctgatcctcggctctttgtggaggagtttctatttcctacttccctgcaaggccctcaggacatggttcacaggactgaactagatgtgataggcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaacactttggtgtagtactgtgtgctgtgtttaactattttatgtatgcattactgtgttgcaacaattagccaatagcatcctaatttgtttagtcagccatttggaatggttgcaatgcattgttgcaaaagcttgtgtttctcatgattaaagtaactttagaagccactagaagacatcttgtatagattttctgattgcgttataaatagaggtttgcagcggtttcttttaattacacagaagcagggtcctaataacctgagatcttaaatcatcacttttgattttatagtaatttgtgctttaaaatagatgtatttatattgcacttcatactctattctttatagttcgagccatagcttgtttcctattaatgcttttcctgtctagttgtgttttacttaactgcctataaaaatcgtaagagtaatttttttcagttgatgtactgattgagcttgagttgctgttatacagcatttgacaggaactataccttggaaaatcagattgtgattctcagttctgtgttgcttttggtttgaagagttttgggaacgttttaattattaattacccttctctaaactttaaaaaaaaaaaagcttttctcattaaaacataccatttgtgcaggtccttaagctatacagattctaaaaattgttagtattgagacattaacttctaagatttctcttttttggcctccaacctatatagaattgagtgttaactctgcatggattttgtttgttttaattgaactgacttctctaactctcatagctgtgagttccaaatggcaagaaaatgcatcttttctatatatgtatcacgataggctatagcatgtttatgactctggtttctttctcttcaggtggttttataccattactgttaatgttattttaacttggcatgtataacattgccatatagagtagagtagaaagttgcaaattttgatagtttacagagttaaacactaaacatatccaaagtccatttagagttttgggtgttgtattttgccatttttgtgatgtgtggccttttattctgtaatctcttctaaataaaacattgaacatccagcaaacataaaacctgcctcatttgaaaaggaatttcaaaattccaattaataggattctctagagagttttgtactttaatatttgtcagtgtagtgtcaactctgttaccaaggtagcttcttggtaaatccagtagctactcaatgctatttgtactgaataaagcaattattaacatgatacttcccactattgattaatgcaatattgatatatttggcgttgtggtagctgttgcagaatgaatagtgtaatgaccataagattgcttggaaaattgtaatacagatatccacaatgaattctttccaaaatttttttttccgatgataaaagt

SEQ ID NO: 452537 - DNA, 3483 bp, Homo sapiens
ggcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagaggtcttaattttacttttctaatgctagctttatattctgatttcctttctgtaaatctgttaggattttgggtcaattatatgaaactgttaaaatagtgagaaatatagcatggagcgtaggacttttgatattccacagtctatagattaaattttgggtacgttcattttcttttgaaagaaaacctatcagttcatttttttgtgtactcaatgaaataatacagctttggtgttacagatttgtgtgtttataggaggattatgggatttatgaaaattgcagaaaaccaccagttgtttttcctattttcagtagcagtcccctttgctcttacgatagcataaggatagaaagcagataatgtcagtgtattttactttcttttccattttgcttgaaataatctgtgtttgtactaaaacttgtcttcatctgcctatggctcaaatgcagttaatttctttacccatgttttaaagtattttaaatttatcagagtgcattgtcacatagtttcatattttttatccattttgtaggaaaatattttttgagagtgtgataatcgaaacgttttgttttgtttgttttttgattggttagttggtttgtcagaggaatagaagatttttcccatgcgatcacatctttggtaaggacaggatgtttatattatagtgatataaaggaaagaaataccaacaattggatacttccgtaaggacataataaccaactgtaacttgttttgtgtgtttctgtctgttaagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452538 - DNA, 2653 bp, Homo sapiens
ggcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452539 - DNA, 1838 bp, Homo sapiens
ggcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaatgaaataaaagaaaatcagagaagtccagttagagtaaaagagagaaaaataacagatcacaggaatgtatctgagagtcc

SEQ ID NO: 452540 - DNA, 1567 bp, Homo sapiens
ggcgcttccggtgcgacgctgtctctccatgccaggactgagttgtgggggagggaggcggttagcgggctttagcgccttttctggcggcggtagatttgaagcgcttcaaaggaccggacccagagaagaggaaaactctaccggtgcaggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgttgtctttgtacaggtgaaaaggggaccgggaaatcaactcagaaaccattacattataagagttgtctctttcacagagttgtcaaggattttatggttcaaggtggtgacttcagtgaaggaaatggacgaggaggggaatctatctatggaggattttttgaagacgagagtttcgctgttaaacacaacaaagaatttctcttgtcaatggccaacagagggaaggatacaaatggttcacagttcttcataacaacgaaaccaactcctcatttagatgggcatcatgttgtttttggacaagtaatctctggtcaagaagttgtaagagagattgaaaaccagaaaacagatgcagctagcaaaccgtttgcggaggtacggatactcagttgtggagagctgattcccaaatctaaagttaagaaagaagaaaagaaaaggcataaatcatcatcatcttcctcctcctcatctagtgactcagatagctcaagtgattctcagtcctcttctgattcctctgattccgaaagtgctactgaagagaaatcaaagaaaagaaaaaagaaacatcggaaaaattcccgaaaacacaagaaagaaaagaaaaagcgaaagaaaagcaagaagagtgcatctagtgagagtgaagctgaaaatcttgaagcacaaccccagtctactgtccgtccagaagagatccctcctatacctgaaaatagattcctaatgagaaaaagtcctcctaaagctgatgagaaggaaaggaaaaacagagagagagaaagggaaagagagtgtaatccacctaactcccagcctgcttcataccagagacgacttttagttactagatctggcaggaaaattaaaggaagaggaccaagggtaggtgattctttccccagagatcttcacaatattgcatttgtcttccttaaataattttagggtgtttcttaaatattattttaatgtgcaagtaactaaaatttaggggagatgcaggcattgaattatatattctctttcttaagcagcttctgtatgttggtacttcccaacagaaaatccatgagatatgaatagattttacatttacatggtataaaatgggatcgaggtctttcttgtctcccgtgtttcttggcaatcactgtatctctattcttgttaaaaataaataaaaattaaccctattcttgtattttattctt

SEQ ID NO: 452541 - DNA, 1598 bp, Homo sapiens
agaggcccggaacacacaagacaagcataccatcagatcgtcacatactagacttcacccatggtgcgaagtatagagaactcatactttactaaagttggcaggagtgttcacagaagaggaccaaggcgttatcgaactccttccagatccagatcaagggatcgtttcagacgtagtgagactcctccacattggaggcaagagatgcagagagctcaaagaatgagggtatcaagtggtgaaagatggatcaagggggataagagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452542 - DNA, 1757 bp, Homo sapiens
  misc_feature (26)..(26): n is a, c, g, or t
  misc_feature (62)..(62): n is a, c, g, or t
  misc_feature (72)..(72): n is a, c, g, or t
  misc_feature (78)..(78): n is a, c, g, or t
  misc_feature (257)..(257): n is a, c, g, or t
taagagtaattttttccagttaaggncctgattgagcttaagttgctgtatacagcatttgncaggactatnccttgnaaaatcagattgtgattctcagttctgtgttgcttttggtttgaagagttttgggaacgttttaattattaattacccttctctaaactttaaaaaaaaaaaaaagcttttctcattaaaacataccatttgtgcaggtccttaagctatacagattctaaaaattgttagtattgagncattaacttctaagatttctcttttttggcctccaacctatatagaattgagtgttaactctgcatggattttgtttgttttaattgaactgacttctctaactctcatagctgtgagttccaaatggcaagaaaatgcatcttttctatatatgtatcacgataggcgagtgagttgaatgaaataaaagaaaatcagagaagtccagttagagtaaaagagagaaaaataacagatcacaggaatgtatctgagagtccaaacagaaaaaatgaaaaggagaagaaagttaaagaccataaatctaacagcaaagagagagacatcagaagaaattcagaaaaagatgacaagtataaaaacaaagtgaagaaaagggccaaatctaaaagtaggagtaagagcaaagagaaatcaaagagtaaagaaagagattcaaaacataatagaaatgaagaaaagaggatgaggtcaaggagtaaaggaagggatcatgaaaatgttaaagaaaaagaaaagcagtctgattctaaaggaaaagatcaggaaaggagtagaagtaaagagaagtctaaacagttagaatcaaagagtaatgagcatgatcacagtaaaagtaaggaaaaggatagacgcgcacaatccaggagtagagaatgtgatataactaaaggtaaacacagttataatagcagaacaagagaacgaagcagaagtagggacagaagcagaagagtgcgatcaagaacccatgacagagatcgcagcagaagcaaggagtaccatagatacagagaacaggaatacaggagaagaggacggtcacgaagccgagagagaagaacaccaccaggaagatcaagaagtaaagataggaggagaaggaggagagactcacggagctcagagagagaagaaagtcaaagcagaaacaaagacaaatacagaaaccaagagagtaagagctcacacagaaaagaaaattctgagagtgagaaaagaatgtactctaaaagtcgtgatcataatagctcaaataacagcagggaaaaaaaggctgatagagatcaaagtcccttctcaaaaataaaacaaagcagtcaggacaatgaattaaagtcctccatgttgaaaaataaggaggatgagaagatcagatcctcagtggaaaaagaaaaccaaaaatcaaaaggtcaagaaaatgaccatgtacatgaaaaaaataaaaaatttgatcatgaatcaagccctggaacagatgaagacaaaagcggatgagtgagttatataaacttacttccattctgtttcggattttaagtttgagagacttgctaatgaatctcctttatgttgttttccttttcattgtttttggattgttttatgtttgtccttttttttcttaatgtggatttcattgagttgattttttgataatctgcaatctggataatttgtactgctaaagttttaataaactcgacatgagaaaaaca

SEQ ID NO: 452543 - DNA, 707 bp, Homo sapiens
gctacaaagcccacaggcagagaaagaactcctcaagtgcttgtggtcagagactaggttccatatgaggcacacctatgatgaaggtcttcacctccagaaggtgacactgttcagagatcctcatttcctggagagtgggagaaaatccctcctttgggaaatcccttttcccagcagcagagcccacctcattgcttagtgatcatttggaaggcactgagagccttcaggggctgacagcagagaaatgaaaatgagtacagttcagatggtggaagaagcatggcagtgacatcttccatgctctttttctcagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagctgca

SEQ ID NO: 452544 - DNA, 1230 bp, Homo sapiens
agaatttcctcaaaaaatgacattttttttttttaccatcgtcataatcaaaaagcattgcttgagactagggttgccagatttaccaaattaaaatatagaatactcagtttagttggaatttcaaataaaaagcaattttttttgcatgtcccatgcaatactggagcaatattttggacatagttacactaaaaaattactcattactcatctgaaattcaaatttaactagatgttctctattttatctggcatccctaattgagacccttctccgaagatacaaagagatagcagtcccagttgctgtcgctctttgggagttttcaatcaggtcaaagataaaatgaaaggagttaaacaacagttcagagcaaggcaatggacttcaaaagtcctaacactgctcaactcctgactgcccaagtcccaaacctgtaagtcagcctacttctcatcttggtgtcctcagcagctaccaagacacctagccaactggtcgacatctgctaagtactcaacaatcacctgttattgactcaatcaagccatcagttaattaacagaagatcatttcctctttcagaaatctgctttggaaaacatgttatccgagacccagtctcggtactcctgcaagctccaggacatgcaagagatcatctcccactatgaggaggaactgacgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagctgca

SEQ ID NO: 452545 - DNA, 1006 bp, Homo sapiens
ggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaaggtaaatgaacaatggaaaaacttcacggcaagattagaaagatacctgagcccaatacccgcctgatgtcgtgggccacacctccgggttaccaggggaagggaggaagcaaactgtcatattgatgtggctctaaacaacaacagtgtgcgaaggcccaggggcactttgggattgaccaagaggaaacacaagttgcacaatgatacaatcttgttggtacaattgtcagagaagggaactcccacagcaaaggccataaaaccatccagggcagtctggggcggctcagttctgcggtgccagggagtggagcagagctcagccccgtcccaaacacagatgggaccatgaactccggacacagcttcagccagaccccctcggcctccttccatggcgccggaggtggctggggccggcccaggagcttccccagggctcccaccgtccatggcggtgcggggggagcccgcatctccctgtccttcaccacgcggagctgcccaccccctggagggtcttggggttctggaagaagcagccccctactaggcggaaatgggaaggccaccatgcagaatctcaacgaccgcctggcctcctacctggagaaggttcgcgccctggaggaggccaacatgaagctggaaagccgcatcctgaaatggcaccagagtctgcagaagacatttcccattaggaactccacttgagacaatggtgacaacccgcgctatttcctacagggaggtgtccccatcctt

SEQ ID NO: 452546 - DNA, 2150 bp, Homo sapiens
ggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaaggtaaatgaacaatggaaaaacttcacggcaagattagaaagatacctgagcccaatacccgcctgatgtcgtgggccacacctccgggttaccaggggaagggaggaagcaaactgtcatattgatgtggctctaaacaacaacagtgtgcgaaggcccaggggcactttgggattgaccaagaggaaacacaagttgcacaatgatacaatcttgttggtacaattgtcagagaagggaactcccacagcaaaggccataaaaccatccagggcagtctggggcggctcagttctgcggtgccagggagtggagcagagctcagccccgtcccaaacacagatgggaccatgaactccggacacagcttcagccagaccccctcggcctccttccatggcgccggaggtggctggggccggcccaggagcttccccagggctcccaccgtccatggcggtgcggggggagcccgcatctccctgtccttcaccacgcggagctgcccaccccctggagggtcttggggttctggaagaagcagccccctactaggcggaaatgggaaggccaccatgcagaatctcaacgaccgcctggcctcctacctggagaaggttcgcgccctggaggaggccaacatgaagctggaaagccgcatcctgaaatggcaccagcagagagatcctggcagtaagaaagattattcccagtatgaggaaaacatcacacacctgcaggagcagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaagaccttagacaacctgaccattgtcacaacagacctagaacaggaggtggaaggaatgaggaaagagctcattctcatgaagaagcaccatgagcaggaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcaggcacagtacagcacgaaatctgctttggaaaacatgttatccgagacccagtctcggtactcctgcaagctccaggacatgcaagagatcatctcccactatgaggaggaactgacgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagctgca

SEQ ID NO: 452547 - DNA, 491 bp, Homo sapiens
tggctcgtagaggatcctacctaaatggctgtcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagctgca

SEQ ID NO: 452548 - DNA, 1466 bp, Homo sapiens
ggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaaggttcggtcattcattaattaattacatctataattgagggtttgttcttaagagcgagtcctttgaaagtactttccttcaaacagtgactgccacaaaggcatcagatattcaccaccttctcggctgcctcagcacagcaagctttattctgggacctgagatcctgttctgagctggctttcccttctccaggctcgctcaccctccctttagagatagtggatggtaagatgaccaatgctcagattattcttctcattgacaatgccaggatggcagtggatgacttcaacctcaagaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcaggcacagtacagcacgaaatctgctttggaaaacatgttatccgagacccagtctcggtactcctgcaagctccaggacatgcaagagatcatctcccactatgaggaggaactgacgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagctgca

SEQ ID NO: 452549 - DNA, 2368 bp, Homo sapiens
ggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaaggttcggtcattcattaattaattacatctataattgagggtttgttcttaagagcgagtcctttgaaagtactttccttcaaacagtgactgccacaaaggcatcagatattcaccaccttctcggctgcctcagcacagcaagctttattctgggacctgagatcctgttctgagctggctttcccttctccaggctcgctcaccctccctttagaggtaaatgaacaatggaaaaacttcacggcaagattagaaagatacctgagcccaatacccgcctgatgtcgtgggccacacctccgggttaccaggggaagggaggaagcaaactgtcatattgatgtggctctaaacaacaacagtgtgcgaaggcccaggggcactttgggattgaccaagaggaaacacaagttgcacaatgatacaatcttgttggtacaattgtcagagaagggaactcccacagcaaaggccataaaaccatccagggcagtctggggcggctcagttctgcggtgccagggagtggagcagagctcagccccgtcccaaacacagatgggaccatgaactccggacacagcttcagccagaccccctcggcctccttccatggcgccggaggtggctggggccggcccaggagcttccccagggctcccaccgtccatggcggtgcggggggagcccgcatctccctgtccttcaccacgcggagctgcccaccccctggagggtcttggggttctggaagaagcagccccctactaggcggaaatgggaaggccaccatgcagaatctcaacgaccgcctggcctcctacctggagaaggttcgcgccctggaggaggccaacatgaagctggaaagccgcatcctgaaatggcaccagcagagagatcctggcagtaagaaagattattcccagtatgaggaaaacatcacacacctgcaggagcagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaagaccttagacaacctgaccattgtcacaacagacctagaacaggaggtggaaggaatgaggaaagagctcattctcatgaagaagcaccatgagcaggaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcaggcacagtacagcacgaaatctgctttggaaaacatgttatccgagacccagtctcggtactcctgcaagctccaggacatgcaagagatcatctcccactatgaggaggaactgacgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagctgca

SEQ ID NO: 452550 - DNA, 1536 bp, Homo sapiens
ggcagatgaaatataagattcatcaaccacatttgacagcccatggcaggtttcctgttttccatcgtccctctgcaggtcacagacacacagagcccagccgtggcaggctcagccggggtccggggctgctaacaacggctacattcctcccccagggccaagggaaatcctgagcgcaggccagggttgtttggttttgaggtgtgctgggatgaaaggcaccctggaagtggaagtgactgccacaaaggcatcagatattcaccaccttctcggctgcctcagcacagcaagctttattctgggacctgagatcctgttctgagctggctttcccttctccaggctcgctcaccctccctttagagatagtggatggtaagatgaccaatgctcagattattcttctcattgacaatgccaggatggcagtggatgacttcaacctcaagtatgaaaatgaacactcctttaagaaagacttggaaattgaagtcgagggcctccgaagaccttagacaacctgaccattgtcacaacagacctagaacaggaggtggaaggaatgaggaaagagctcattctcatgaagaagcaccatgagcaggaaatggagaagcatcatgtgccaagtgacttcaatgtcaatgtgaaggtggatacaggtcccagggaagatctgattaaggtcctggaggatatgagacaagaatatgagcttataataaagaagaagcatcgagacttggacacttggtataaagaacagtctgcagccatgtcccaggaggcagccagtccagccactgtgcagagcagacaaggtgacatccacgaactgaagcgcacattccaggccctggagattgacctgcaggcacagtacagcacgaaatctgctttggaaaacatgttatccgagacccagtctcggtactcctgcaagctccaggacatgcaagagatcatctcccactatgaggaggaactgacgcagctacgccacgaactggagcggcagaacaatgaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacaccagtgagtgagttctaaaagatacccttggaattatcagactcagaaacttttattttttttttctgtaacagtctcaccagacttctcataatgctcttaatatattgcacttttctaatcaaagtgcgagtttatgagggtaaagctctactttcctactgcagccttcagattctcatcattttgcatctattttgtagccaataaaactccgcactagctgca

SEQ ID NO: 452551 - DNA, 893 bp, Homo sapiens
ggctccgggctgggtggggatcggctggctgccccggcccctcacctccatctttctacccccagggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 452552 - DNA, 234 bp, Homo sapiens
gcggccgcctactactactactgctcgaattcaagcttctaacgatgtacgggcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 452553 - DNA, 1177 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtctttaaaaaaaaaaacatttcccaaaaaaaaa

SEQ ID NO: 452554 - DNA, 940 bp, Homo sapiens
aaataggctaggtacgaggctgcgtgttgaatcggccgaggcggacggaagccgacggggcgtgcggagggatgtggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 452555 - DNA, 1000 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctgtcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 452556 - DNA, 1126 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagaggtgccgtatgaccagagccgatggctctaacagtcgtcacctccagacgtgagatgaccacctgtgcaaagactgtaaacagcgcggcgcagaactgtccatagcactgaactggctctctcagatctgtgaggggcaagctgcagacccagctggcctgtcaccctgttgctggctgaagggctctgaggactttattgcagggtgcccgtatggacgggctcaactgaacactgtgaattattaatcttgtgtctttggcaaaaaaaaaggggccgttaagttctgaggccagtatacgttctgtcagtgcctagggtttatat

SEQ ID NO: 452557 - DNA, 1028 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctgtcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtctttaaaaaaaaaaacatttcccaaaaaaaaa

SEQ ID NO: 452558 - DNA, 693 bp, Homo sapiens
  misc_feature (557)..(557): n is a, c, g, or t
  misc_feature (559)..(559): n is a, c, g, or t
  misc_feature (574)..(575): n is a, c, g, or t
  misc_feature (579)..(579): n is a, c, g, or t
  misc_feature (583)..(583): n is a, c, g, or t
  misc_feature (590)..(590): n is a, c, g, or t
  misc_feature (594)..(594): n is a, c, g, or t
  misc_feature (598)..(598): n is a, c, g, or t
  misc_feature (613)..(613): n is a, c, g, or t
  misc_feature (622)..(622): n is a, c, g, or t
  misc_feature (642)..(642): n is a, c, g, or t
  misc_feature (660)..(661): n is a, c, g, or t
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccagggtttcnanatgcacaagatccannaagnatgnccagaanaagngganacgcttgctgttgcntctcatgantcgatcgatcgtggagctgngcgatcacaatgagagcnncgctgaatcttaatgtggggccagctctgtct

SEQ ID NO: 452559 - DNA, 1149 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 452560 - DNA, 1579 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtctttaaaaaaaaaaaaaaaaaaaaaaaaaaaaaaaaaaaaagggggggcccccaaaaaattcccccggggggggccacaagtttagggccgtgacccacaattttggtggacaaaggggggggccccaaagagaaggacagcagaatataagcgccgaaggccagggggacggcggctttaaacacaacggctgggcagcggggaacaaggtgcttcaaagcggggaaaatcttgtgggggagagaaaccctacaatgcgggggggggtgcaacatatgttggaaaaattcctccaaggaagaattagaaagcctcgaagggaaatattaatagtttcagcgggttatataggtgttaaaccgacgcgcaataagctgtgacggagtgaaaaaatggccagggaattgatgatttgggaatatttttttcagga

SEQ ID NO: 452561 - DNA, 1083 bp, Homo sapiens
tctctgctcctcggctcttaatctccgacttccttcctgacacctggcaccgctcccctcattcctacgctcaagactctccccagccattctcaccccttcctttcctgtgtccctagccccctgactccccccttcctgtgctccaaaccccctgggtcctctccactactctctccccatccccttctggggcctaaattcttccccatcccttttactttgggctctggtcccccttcctggttccctgacccatccccagcctcccttaaaactctctccccaccccgaatctggggacacccctgccctctccacctgcagatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 452562 - DNA, 961 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctgggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 452563 - DNA, 831 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtcttt

SEQ ID NO: 452564 - DNA, 512 bp, Homo sapiens
ccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccggtgagcgccccgcgccgggaccctccccaggactctcccaagcgcctgccgacactccctgcgcccctccttccctggccccagactttccctcaggctccgctccccttctaaccccc

SEQ ID NO: 452565 - DNA, 1976 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452566 - DNA, 1546 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgtta

SEQ ID NO: 452567 - DNA, 471 bp, Homo sapiens
cagaccggggagggagaggaggttaagctcttggtggctacttgaagagggctgggaagcaggaggaaagaagctgtggtgatttttaggttggatggaaatggtgaaaccacctgagagaacacaggctgggccagtttgcgggaaaggttggtgagcatgtgggcatggtggttgaatcatctgtgtctaggcagaaattcctgataggcagttgaggaaaacaagctcagtgttggagtaaaagcttcatcaaattaggtttcagtggtatcccctgacattggaaaaggtattatctgctaatatcttaacattttcttttgtcttgtatttgctttcctctggcaggtgcagagattcttagaagaggaggtgtatcccctgttaaaaccatatgaaagcgtgatgaaggtgaaagcagaattatgtctgtagagttggaagagaattaaacgaaaatcattgtta

SEQ ID NO: 452568 - DNA, 1491 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcagctgcagagattcttagaagaggtgctgtggtcccctccgactcccagttgtaagcgtgtctccca

SEQ ID NO: 452569 - DNA, 1369 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggtgcagagattcttagaagaggaggtgtatcccctgttaaaaccatatgaaagcgtgatgaaggtgaaagcagaattatgtctgtagagttggaagagaattaaacgaaaatcattgtta

SEQ ID NO: 452570 - DNA, 1931 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452571 - DNA, 1717 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452572 - DNA, 1851 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452573 - DNA, 930 bp, Homo sapiens
  misc_feature (930)..(930): n is a, c, g, or t
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagaattgcacggctacgctccttgcaacttaagaaatgaagaactttggaaaaacaaatggtctaggcgatgcattaaacgn

SEQ ID NO: 452574 - DNA, 2480 bp, Homo sapiens
ctcattcagcatgcttgcctactcactatcctctgaagtctctctgcctttgcatcttgtcctttttttacatgggcaggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccggtcagtggcacagggacatcacatacaccaagttgagtggaggtctgaaggagggacctagaagtaaaaggacatatttgagcatctctacagtctccttatccccaaggatcccagagtctagcagggaggcaaaaacataaaaaggacagtgtgataagtgttacaattggagtgtgtactgggtactgtggagcaaagaggaaggaatagtgtttgaggagtcagaaagcttcacagtagaggtgatgccttaagacttaagaaatacatgcatcttttaaagacaagatcgggagcattataaaggcacaaagcaggagaaaacacacttgagggagttactactacttgagtagccctggggaatgaagtcaacatgtgccaggaggtggggcaggacatggtcacagatagccagtttatgaaaggtcttctgggtcttttctgaaggcagatagatgtcagttgtggtgtctaggcacaatgacatcttgattagttatgagatgagtcagaaataatttgtaactactgttgaggtgccaacatgcgcatcattttctgttttatgtatatactcacttaaagcagattggcattactctcgcctgctcgcattttgctggaatttcttgagtggatacggatgtatagttaaacctagctttctgggatctgtgcataatccacgatttatctctggaaataagtcatgtgaactcattcagaagtcagccattgaatactttttagcaaggtgtgaccctgtaggtctgctgatttgcctgctaaaagaccctagcaacagtttggagagttggctgtaaggagacagggatcatgtcagaacaagttaggggctactttaaaagtctgaggccacattggtgcagtggccatgtaaatggagaggaaggatatagatccagagtcgaaggcagactggccagcccagccctggtggttgaccggagtgagtataaagagcttggtgagtggggcgctactgccatttactgaggcaggagctacaagggaggaatggcaggtatgtaatggtgagtaggaggaatgagaaagtggctgagttcagtttggggattgaggtacccatagatcaaccaggtggacgtctcactcagtaggtatgaggtctggcacttgagcaagtggtctggcctagaggtgacagatttgagggtcgtgaggttattggggtaatcataagattgaaggagattatccagagagtacagtcagtagggcaacttgttgggacacacactgcatttcactgaaattatttgtttaaagacatactgaatggctatttgttttctagacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452575 - DNA, 939 bp, Homo sapiens
  misc_feature (197)..(197): n is a, c, g, or t
tccctacatggctgttggtcatggagatcctcaatgtcacgctggtgccctacggaaacgcacaggaacaaaatgtcagtggtaggtgggagttcaagtgccagcatggagaagaggagtgcaaattcaacaaggtagatatagaagagtcaaaagtgcactcttctatatctaccatcatggccatggtcaaagcnggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452576 - DNA, 264 bp, Homo sapiens
cttattcccctacctcccccagatttgcaccgacatacgcctcctggcaaacctcaaggagatggaggaaccctttgaaaaacagcagattggtgagtgctgtgtagagacctgtgagcacacattgctgctggaaggctgtggatgggggctgagagctcattcagcatgcttgcctactcactatcctctgaagtctctctgcctttgcatcttgtcctttttttacatgggcaggctcaagtgcgatgccatataagcgga

SEQ ID NO: 452577 - DNA, 1799 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452578 - DNA, 3321 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccggtcagtggcacagggacatcacatacaccaagttgagtggaggtctgaaggagggacctagaagtaaaaggacatatttgagcatctctacagtctccttatccccaaggatcccagagtctagcagggaggcaaaaacataaaaaggacagtgtgataagtgttacaattggagtgtgtactgggtactgtggagcaaagaggaaggaatagtgtttgaggagtcagaaagcttcacagtagaggtgatgccttaagacttaagaaatacatgcatcttttaaagacaagatcgggagcattataaaggcacaaagcaggagaaaacacacttgagggagttactactacttgagtagccctggggaatgaagtcaacatgtgccaggaggtggggcaggacatggtcacagatagccagtttatgaaaggtcttctgggtcttttctgaaggcagatagatgtcagttgtggtgtctaggcacaatgacatcttgattagttatgagatgagtcagaaataatttgtaactactgttgaggtgccaacatgcgcatcattttctgttttatgtatatactcacttaaagcagattggcattactctcgcctgctcgcattttgctggaatttcttgagtggatacggatgtatagttaaacctagctttctgggatctgtgcataatccacgatttatctctggaaataagtcatgtgaactcattcagaagtcagccattgaatactttttagcaaggtgtgaccctgtaggtctgctgatttgcctgctaaaagaccctagcaacagtttggagagttggctgtaaggagacagggatcatgtcagaacaagttaggggctactttaaaagtctgaggccacattggtgcagtggccatgtaaatggagaggaaggatatagatccagagtcgaaggcagactggccagcccagccctggtggttgaccggagtgagtataaagagcttggtgagtggggcgctactgccatttactgaggcaggagctacaagggaggaatggcaggtatgtaatggtgagtaggaggaatgagaaagtggctgagttcagtttggggattgaggtacccatagatcaaccaggtggacgtctcactcagtaggtatgaggtctggcacttgagcaagtggtctggcctagaggtgacagatttgagggtcgtgaggttattggggtaatcataagattgaaggagattatccagagagtacagtcagtagggcaacttgttgggacacacactgcatttcactgaaattatttgtttaaagacatactgaatggctatttgttttctagacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452579 - DNA, 1958 bp, Homo sapiens
  misc_feature (860)..(860): n is a, c, g, or t
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgccgantagcctctggaaactcagggatggggaccttgaaaacagaatgctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452580 - DNA, 1896 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaaggcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaa

SEQ ID NO: 452581 - DNA, 1017 bp, Homo sapiens
  misc_feature (860)..(860): n is a, c, g, or t
  misc_feature (912)..(912): n is a, c, g, or t
  misc_feature (915)..(917): n is a, c, g, or t
  misc_feature (920)..(920): n is a, c, g, or t
  misc_feature (924)..(924): n is a, c, g, or t
  misc_feature (929)..(929): n is a, c, g, or t
  misc_feature (934)..(934): n is a, c, g, or t
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgccgantagcctctggaaactcagggatggggaccttgaaaacagaatggtccggggngcnnnaangganccggntcaantgtggttgccccggtactttggcgcaaaatttctcggttggccgcgtttgcccggctggggaaccacattaacggacgtgtcc

SEQ ID NO: 452582 - DNA, 886 bp, Homo sapiens
ggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgtta

SEQ ID NO: 452583 - DNA, 531 bp, Homo sapiens
atgaggtgccagccttgctttatatgttgcccacttataacttatgttggaaaaaatagccctcttaggaaaagacataaaaagtgaacttacgttgctagagagaagcttgcacaccatcataagataaaaaacaggcctctggctccaccgtctcattgaagtgatgctgtttatcctccccactaatctgcactcctcacatggatcacagcccagacaacatgcagacagagaggcagatgcagagctcactgactcagtgagcacagctgggggagatcattaaacagaccactcctgccaaacagcctgcggtggtggaacacgaagacttccttgcctcgccacatggagaaagaatttttttttcccggagacatgtatagtagaataattatacactatctgagtgccagttattaaaaaacagctaacggtattaaaaattaaaaaaatgagagagtgagtaagctaggacactttgaatacttcataagttatacctatgctacttcaatttaaatcctt

SEQ ID NO: 452584 - DNA, 1051 bp, Homo sapiens
  misc_feature (25)..(25): n is a, c, g, or t
  misc_feature (794)..(794): n is a, c, g, or t
cggacgcgtgggtcgaccacgcgtncggtaggacacagtgagaaggcaccatctaccaaccagagagtgggtcctcagcagacactgaatctaccagtgccttgatcttggacttcctagcctccagaaccgtgagaagtaaatttctgtttatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtgtggactgggatataatgggnaaaatcgggccgaatgaggaaatgggagagcgcgataaaaattttaccaaattggaaaggggttaaaaggcgtgtcaacaacgggataataggaattgggcggcggagggggtggagaaattacaccgggtgttcattacgggggatagggggaagacagatatagagagaggagtcagctggaaaacaacatgtggtgttatagttttataaagaaaacgtgttttcgcctgctctcttccttacaaataaaaagt

SEQ ID NO: 452585 - DNA, 808 bp, Homo sapiens
  misc_feature (25)..(25): n is a, c, g, or t
cggacgcgtgggtcgaccacgcgtncggtaggacacagtgagaaggcaccatctaccaaccagagagtgggtcctcagcagacactgaatctaccagtgccttgatcttggacttcctagcctccagaaccgtgagaagtaaatttctgtttatttaaacagtcaagtaaaatcaagctgggtaatcatggcagaaggtggatttgatccctgtgaatgtgtttgctctcatgaacatgcaatgagaagactgatcaatctgtaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagagtatcttctgccgatggaccactca

SEQ ID NO: 452586 - DNA, 3746 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452587 - DNA, 4054 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcacttaaaaatgtctgcatgggctgggcacggtggctcacgcctgtaatcccagcactttgggaggccgaggcaggcgaatcacctgaggtcaggagttcgagaccagcctgaccaacatggtgaaaccttatctctactaaaaatgcaaaaattagccaggcatggtggtgtgtgcctataatcccagctactggggaagctgaggcaggaaattgcttgaacctgggagacggaggttgcagtaagctgagatcgtgccactgcactccaatcagggcgacagagcgagactctgtctcaaaataaataaataaataaaaatgtctgcatgacccatatggttatgaagtttttttcctagcaaatgattgcagattatttatgggggctagaagatattttgctatcaatgtaaggatttttttccccttaggtcagtctattcactgtttagatctggtaaattacttgtatgaattgaataaattctctgtatcattgtactgtttaatagtctctgatacaattgtgatactcataaggtattttcccccctttattatgattacattctagatcataaacattgtaagggcatcttttcattatataatccaatattgattgtttgaattcctccttgtacatcctggctttgtgctcaatttcttgaaataatataaccaactctaaattacttgtgttaatagatcggtaacatgacacaggtaagttaaatcctggataaatgagccccacagaataaaggtttttcctcttgctgtggcctactggaagccttcctaactctatagctggtaaagtagagcagaaagggccagaatggcttaagatggagctaaatccctatagcattccattttctgctcttgcctcttgaacttagaaggcttgcccatatatcctaacaatctgttctctgagctgttaggccaatccctggcaagagatattgatgtagtcactgaatctatggctcacaaataattgaaaattggctttgggagctgggcgcagtgactcatgcctgtaatcccagcactttgggaggctggggcaggtggatcacttgaggtcaggaggttgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452588 - DNA, 3433 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452589 - DNA, 3299 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452590 - DNA, 4299 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaacaaaaaaaaaaaaactaataaaacaaccctgtgctcgggccgcgccttggcgcccgctgaagaaacgctttttaaacaccatttgttttgggccgccggggcccgcaaatgtgggtaagcgagaccggtggccaaatagctgtgtcccatagagaccactcggggacagacacaacggcggcctcggggactcctccgcgccaagataaaaaaaagcggccccgagctggaaaaccacacagcgcgcttgctagtgaaccaaaatccccagcaataggagactcccgagagagccccacaccacgggggcctctactcaacagggggagcccccagaggagaaactcgtagaatatcaagaattttagcccccgcgcgtgccggtgttacatcaagtatctcagtgaacctgaccacagacgactatactaaacacgaccgcagcgacaacacacacaaacaacaacactagcgacgacgcgaaaacgacacacacgactaacagatacacagctcaacacacaaccaaccaacgccacacaacacagccacgcc

SEQ ID NO: 452591 - DNA, 2915 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaaaaaaaaaaaaaaaaaaaaaaaatttggcggcggcttgggcctcaagaaaaagttttaagcccctcctgtgtggggcgggggcccagagggttatcgcacacctggccaacccgtggccagggagaaccccggccgagaaatgggtgggtttccccaaaaaaacgccggggaaccgcgtgttggacaaccaagggggctcggggccaccgccctcacagaggccaggggcctaag

SEQ ID NO: 452592 - DNA, 1302 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggca

SEQ ID NO: 452593 - DNA, 3639 bp, Homo sapiens
  misc_feature (25)..(25): n is a, c, g, or t
cggacgcgtgggtcgaccacgcgtncggtaggacacagtgagaaggcaccatctaccaaccagagagtgggtcctcagcagacactgaatctaccagtgccttgatcttggacttcctagcctccagaaccgtgagaagtaaatttctgtttatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452594 - DNA, 3784 bp, Homo sapiens
  misc_feature (25)..(25): n is a, c, g, or t
cggacgcgtgggtcgaccacgcgtncggtaggacacagtgagaaggcaccatctaccaaccagagagtgggtcctcagcagacactgaatctaccagtgccttgatcttggacttcctagcctccagaaccgtgagaagtaaatttctgtttgtgttgacagagtggcctcagacaaaactgtgaagtagagtttgcatatggtgttgcttaccttctggaaagtgagcctctccagctcaggccgcatctccatctccctttccaattctcacctccccttctccccttagctcagatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452595 - DNA, 3697 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgtaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452596 - DNA, 3653 bp, Homo sapiens
atcccatgaacatagaaggttaaggctgtagtgagctatggttgtgccaccgcactccagcctgtttgatagagcaagaccctgtctcaaaaaacaaaaacaacaaaaacttactaagttttggtttatgactatttaacatcatttactttttagatgttctcactgggggaaagggaaattgaagatataatatgtacttttgtaatttatcaatacaatttttatattaatacagtaattgaaactgacatttaaacattagaatttgtttttacttttaacaatattgtgagcacatgctacattttttgtttgtctttagtaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452597 - DNA, 3554 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452598 - DNA, 964 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagagtatcttctgccgatggaccactca

SEQ ID NO: 452599 - DNA, 1976 bp, Homo sapiens
gatgaaatggctgaaacttggatacagaatgtctagtattagacacctaaaaatctggattctttttggttgttgttttgagatggagttttgctctttcgcccaagctggagtgaagtggcgcgaccttggctcactgcaacatccacccccaggttcgagcgattctccttcctcagcctcctgagtagctgggattataagtgcccaccaccacgcccagctaatttttgtatctttagtagagatggggtttcgccatgtaggccaggctggtctcaaactcctgacctcaggtgatccacccactatggcctcccaaagtgctaggattacagatgtgagccaccgtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452600 - DNA, 1663 bp, Homo sapiens
gatgaaatggctgaaacttggatacagaatgtctagtattagacacctaaaaatctggattctttttggttgttgttttgagatggagttttgctctttcgcccaagctggagtgaagtggcgcgaccttggctcactgcaacatccacccccaggttcgagcgattctccttcctcagcctcctgagtagctgggattataagtgcccaccaccacgcccagctaatttttgtatctttagtagagatggggtttcgccatgtaggccaggctggtctcaaactcctgacctcaggtgatccacccactatggcctcccaaagtgctaggattacagatgtgagccaccgtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452601 - DNA, 1041 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcgggtgttgacagagtggcctcagacaaaactgtgaagtagagtttgcatatggtgttgcttaccttctggaaagtgagcctctccagctcaggccgcatctccatctccctttccaattctcacctccccttctccccttagctcagtttttttttgtttttttaaaaaacaccaggttcgggtttcggcactcagggctcagagtgcagttgtgtgtgacacatagctccgtggggggctctaaaatctacctggactacaagcaggaatccccccttatttcaggctcttcccagaagtatttgggaccataaccagatttaaacactgcacagtacaaccagccggcgtactcagggccgaagggtggctttgaacccctgggcaaatggtgtgggctccatgaacttgccatgcagaaagactgtccactcgtggttacggcgagcccaaggacttactggagcaggaaccaaggtgtctccagggataaccgggagccccggggagaaatgcctccggggacactgctctggttagcctggagggatgctagaacctgtcacgagagccccaattaaggggaacagctatgggaagcccacgttccattggagagacaccgctcctgggcaactgggatcgcaggcgatgtacctcgcgcggcagagaggaggcagtatcaaccaagagggctggattcgacagagatcgaaacgcaacactcaatggcgagcacaacaatagaagtacagcgggtgacaccttcctgtttgccctgcc

SEQ ID NO: 452602 - DNA, 3685 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaacaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452603 - DNA, 4953 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaacactttgtgttttctgtttggcttttgtgggaagagaagcaagcatcttttgcctagtagatgttaacattgtgtattaaacagtttctttgtaagacctaactaaagacattcctaagagagaacttaagttttaagaaaagttgtgagaaaaatattcataaaatatgcagtatggggccagtattcagaagtagagtttctctcttggaaattagattgcagtcacatttctttggttattttctttctctctctcttcctagaataccaggtaaaatagacatttactttgagggactaatatccaatagtgttaattatttaagcagatatatctagctcaaaaggaaccagacatgtcactgtaccaaaaacacacaaaagtgaaaatttgcttctgttctgtgacctagaatgtgtccagacattaaagatcatgaatactcatatacatgtaaaaatagtaacactgctctggcatgattttgacgtcagtgtttatgtaataacttcagtgttatatttaaaatagataaatttgtgaaataacaatttcttggagacagtcaactttttatgatttaatctaaagattgtcatgtacatgtcaacggatatctgaatcctcagtgaaactgttaagttttcattaaatgactctgctgcaatactagttttcttctcagaaaatggaattcaaataaaataagttttttggtcttggcatttcacctgatgactttctctgttctggatctcaatttgtagagttgttgggggttcccccccctccaaaagatgctccataaacaccaactacaattatctttcatgatcatatttttaaaaattggagttacctgtgtgatcttttcccattagttgcttgtaggggactttagtgtgcgtatctcttctcagacaaatgtattatgttcgttcaataaacacttcaacaaatttttatacttgtttcttaactctctataggctttaaaatggattttattcaggatttgattacagaaactatttcaaaccatcagatgccaaattgtctactgacgttagtgaggagatgtctgggaggcaaggactatgtaggggtgaaaacaatatatatagttttaaagataaagcaactttctttcttttttctttttcttttttttttttttttttttttgagacatagtatcactctgt

SEQ ID NO: 452604 - DNA, 1790 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctc

SEQ ID NO: 452605 - DNA, 3599 bp, Homo sapiens
ggcggggcagctggagtctccaggcgctgcaatctgttgcgccgccgcccgcgggagccggcagatccgggtcttgtggctaagagtgacgtggtcactcgaatcaaaacagatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452606 - DNA, 3603 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacagtccattatatgacatttgtaagccactcaacactagccttacaaggttcatgaaaggaggaaaacattaattctttctgcctttgctgatataatccacatagtaataatttaagctataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcagtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaattgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagtaaca

SEQ ID NO: 452607 - DNA, 855 bp, Homo sapiens
ggcggggcagctggagtctccaggcgctgcaatctgttgcgccgccgcccgcgggagccggcagatccgggtcttgtggctaagagtgacgtggtcactcgaatcaaaacagaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcataatggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttcgaactgggatatacctttgggataattctggccg

SEQ ID NO: 452608 - DNA, 423 bp, Homo sapiens
  misc_feature (1)..(1): n is a, c, g, or t
  misc_feature (10)..(10): n is a, c, g, or t
nattcggcangagggggagcactgtgtttatgctggaatatgaagtctgagacttccggtgctgggaacacacaagagttgttgaaaacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452609 - DNA, 364 bp, Homo sapiens
ataggagtggtgagagagagaacccttgtcttgtgccagttttcaaagggaatgcttctagtttttgcccattcagtatgatattggctgtgggtttgtcataaatagctcttatacatttcatcaatgcctagtttattgagagtttttagcatgaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452610 - DNA, 3424 bp, Homo sapiens
gaactataggcaggtacgaggccgcggttaaggagacgccatgccgggggctgggatcaccatgccccttgcccgtctcgcaccttgctgctgtctgtaaccccccagcacctcccgcaggcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452611 - DNA, 3741 bp, Homo sapiens
cccatggcaacagcctgctatgagtagccagccagggcagaggccgggctgcaggtggaggcggggaagcgattccggccacctttgtgatgggcgtctcactacctacaaagtcagcccagtgatttcaagacagccctggagacagtgcttcctgccctcctgtcagcttctgcctccctgtaatgtgttctgggtggtctagctcagtcatctggagacacacacaagcacaggcacttcgtagctgttgaccatcatttagctccacgtctgcccgtcggttcctcgtgcgtggaatccagcaccacgtgggtgtctctgccgagctctcggcatttcctgagccctcccggaagccagactctgttctcggcgcttcacacgggccgtctcgtctgatgctgtggcgtcctgcagggtgggaacgggcggtgcccgtggacgtggcgctgtgcctgccggcgtcctgggcaccacagcgttgccgcttgcccactgcctcctagcatggccagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452612 - DNA, 3044 bp, Homo sapiens
agctcggtgatccccgtctatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452613 - DNA, 3074 bp, Homo sapiens
aagcagctcggacctcataggtcgcaggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452614 - DNA, 2880 bp, Homo sapiens
aacgggtgatgcggttgtccacagatagatttaggaacgggtgatgcggttggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452615 - DNA, 3903 bp, Homo sapiens
  misc_feature (3734)..(3734): n is a, c, g, or t
  misc_feature (3752)..(3752): n is a, c, g, or t
  misc_feature (3822)..(3822): n is a, c, g, or t
  misc_feature (3852)..(3852): n is a, c, g, or t
  misc_feature (3855)..(3855): n is a, c, g, or t
  misc_feature (3858)..(3858): n is a, c, g, or t
  misc_feature (3863)..(3863): n is a, c, g, or t
  misc_feature (3866)..(3866): n is a, c, g, or t
  misc_feature (3868)..(3868): n is a, c, g, or t
  misc_feature (3877)..(3877): n is a, c, g, or t
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaacaaaaaaaaaacaaacaaaaaaaaaaaaaaatgtgtgtcggcgcgcgcgccncgggcccctggaaaaagnttttaaagaacaatcgggtggggccgccgcggggccccaatagggaaagggaaacggggccaaagcgggntcccaagaggaaaaccggggcaaagaaaanggngcnggggnttncncccacattnaaaaaacggccgggggggaaacccga

SEQ ID NO: 452616 - DNA, 3941 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaatcgatgtcgactcgagtcaggctgcggatccgatgtttgggcatatggcttaggattgacttggcgatgtcgactcgagtcagtgcggatccgacgtttgggcgttcgggcggagcgaattcgatgtgtgggcgtacggcttaggattgacttggcgatgtcgactcggtcagtgcggatccgatgtctgggcatacggggcgatgtcgactcgagtcagtgcgaattcgatgtctgggcatatggggcgatgtcgactcga

SEQ ID NO: 452617 - DNA, 2217 bp, Homo sapiens
atacaggcacattatgtaacatacacacgcaatgaaaccgaagctggcggcctgggcgtggtcttgcaaaatgcttccaaagccaccttagcctgttctattcagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452618 - DNA, 1816 bp, Homo sapiens
atgtcataatggaccagtccatgtgatttcagtatatacaactccaccagacccctccaacccatataactccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452619 - DNA, 1777 bp, Homo sapiens
gggtgacacactcacttctttctcagcctccaggacactatggcctgggagggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452620 - DNA, 1723 bp, Homo sapiens
agaggatccctttctgccaacgactcgctccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452621 - DNA, 3983 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaacacaacacaacaccacaacaaaaaattggtgtgggccggccgtggcgacacagaaagaaagggcctttataaacaccactccggtgtgtgggcgcgcgcgggcaccccagagagggtaaggctgacagtgggcaacaggggggccccaagagaacactggggccacgacacacgtgggcgttgttccccccaaaaaaaacgcgccggggggcacaccggcgcgttgggacacaacaccaagatgaggtcggaagggcgacagcgggccatacaaaggggagcaaaagggacccgaatataaattaccgagcgcgtaggac

SEQ ID NO: 452622 - DNA, 1668 bp, Homo sapiens
ataggtcactctacagcatgacaacgcccctgggcaagggaccgcttcctggaaaccctcccagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452623 - DNA, 3396 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttca

SEQ ID NO: 452624 - DNA, 997 bp, Homo sapiens
ccccctgatcgagccggtaccagcaggctgggcccagattagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452625 - DNA, 3103 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452626 - DNA, 938 bp, Homo sapiens
ttatatccagtacctacactaggatccctcatcctagatccactagttgataaaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452627 - DNA, 2795 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacgcatcacccgttcgggatcctcatg

SEQ ID NO: 452628 - DNA, 2064 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctccaaaatccttcccttcctaggctggacttcttactatgcttagctggcgtcacatgcagaaagccccgtgcagagatggc

SEQ ID NO: 452629 - DNA, 671 bp, Homo sapiens
  misc_feature (1)..(1): n is a, c, g, or t
  misc_feature (10)..(10): n is a, c, g, or t
  misc_feature (502)..(502): n is a, c, g, or t
  misc_feature (520)..(520): n is a, c, g, or t
  misc_feature (590)..(590): n is a, c, g, or t
  misc_feature (620)..(620): n is a, c, g, or t
  misc_feature (623)..(623): n is a, c, g, or t
  misc_feature (626)..(626): n is a, c, g, or t
  misc_feature (631)..(631): n is a, c, g, or t
  misc_feature (634)..(634): n is a, c, g, or t
  misc_feature (636)..(636): n is a, c, g, or t
  misc_feature (645)..(645): n is a, c, g, or t
nattcggcangagggggagcactgtgtttatgctggaatatgaagtctgagacttccggtgctgggaacacacaagagttgttgaaaacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaacaaaaaaaaaacaaacaaaaaaaaaaaaaaatgtgtgtcggcgcgcgcgccncgggcccctggaaaaagnttttaaagaacaatcgggtggggccgccgcggggccccaatagggaaagggaaacggggccaaagcgggntcccaagaggaaaaccggggcaaagaaaanggngcnggggnttncncccacattnaaaaaacggccgggggggaaacccga

SEQ ID NO: 452630 - DNA, 1061 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagccttttaacacatgaacagctactgacatacccatcctgaagacggactgggtacca

SEQ ID NO: 452631 - DNA, 390 bp, Homo sapiens
ctcctgtcagcttctgcctccctgtaatgtgttctgggtggtctagctcagtcatctggagacacacacagtaagtaccacccctcttccccaagcatttcaggtgcttctcgtggtgacaagcactggcatctctgtagatgggtgctgctgttgttatcatccccatcctaaagagcaaactgaggcacccagagtgaagtcgcttggcctaggtcacatagtactcttaagcaccatactctgccattctagacttttctatcctttgcaaacacccttgccccacctcacctcctttggcttttcttcctaggacctttggtcagtgggcccctcctgaccaaaggagttcattctcctcctggactccaagcctgcggcctcttc

SEQ ID NO: 452632 - DNA, 3655 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452633 - DNA, 3422 bp, Homo sapiens
ggctgggcatcatctctcagcctggaggaggagacgccatgccgggggctgggatcaccatgccccttgcccgtctcgcaccttgctgctgtctgtaaccccccagcacctcccgcaggcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452634 - DNA, 3381 bp, Homo sapiens
aaagtttgcactggattttattggagccccatctccccagcggcaggcgggcggactgtatatatgtatatactcagtgcttcctgccctcctgtcagcttctgcctccctgtaatgtgttctgggtggtctagctcagtcatctggagacacacacatgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452635 - DNA, 3718 bp, Homo sapiens
cccatggcaacagcctgctatgagtagccagccagggcagaggccgggctgcaggtggaggcggggaagcgattccggccacctttgtgatgggcgtctcactacctacaaagtcagcccagtgatttcaagacagccctggagacagtgcttcctgccctcctgtcagcttctgcctccctgtaatgtgttctgggtggtctagctcagtcatctggagacacacacaagcacaggcacttcgtagctgttgaccatcatttagctccacgtctgcccgtcggttcctcgtgcgtggaatccagcaccacgtgggtgtctctgccgagctctcggcatttcctgagccctcccggaagccagactctgttctcggcgcttcacacgggccgtctcgtctgatgctgtggcgtcctgcagggtgggaacgggcggtgcccgtggacgtggcgctgtgcctgccggcgtcctgggcaccacagcgttgccgcttgcccactgcctcctagcatggccagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaa

SEQ ID NO: 452636 - DNA, 4024 bp, Homo sapiens
  misc_feature (3698)..(3698): n is a, c, g, or t
  misc_feature (3730)..(3731): n is a, c, g, or t
  misc_feature (3762)..(3763): n is a, c, g, or t
  misc_feature (3766)..(3766): n is a, c, g, or t
  misc_feature (3769)..(3769): n is a, c, g, or t
  misc_feature (3771)..(3772): n is a, c, g, or t
  misc_feature (3774)..(3775): n is a, c, g, or t
  misc_feature (3788)..(3788): n is a, c, g, or t
  misc_feature (3790)..(3790): n is a, c, g, or t
  misc_feature (3792)..(3792): n is a, c, g, or t
  misc_feature (3795)..(3795): n is a, c, g, or t
  misc_feature (3812)..(3813): n is a, c, g, or t
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaacgtgggcgggcgcgcgccngggcccctcgaagaaagctttcaaaaacccanncgcgtgggggcggcgcgggggcccagggggnnaanggngnnanngtgggccaaaagngngntcncaaaggaaaccggggcnnaggcaaagggcggggggactctccaccaacaatacaaaaaacaggcacgcggggcgggcacaccgcgcagggtttcatcgcacaacaatcccccaaaaagtggggagatcgcaggagagggacacaacgagggacctacataacagacgggggatgccacaggggcaaaccgcacaattcaaaaagagccccagagagccgagggggaatt

SEQ ID NO: 452637 - DNA, 3879 bp, Homo sapiens
  misc_feature (3710)..(3710): n is a, c, g, or t
  misc_feature (3728)..(3728): n is a, c, g, or t
  misc_feature (3798)..(3798): n is a, c, g, or t
  misc_feature (3828)..(3828): n is a, c, g, or t
  misc_feature (3831)..(3831): n is a, c, g, or t
  misc_feature (3834)..(3834): n is a, c, g, or t
  misc_feature (3839)..(3839): n is a, c, g, or t
  misc_feature (3842)..(3842): n is a, c, g, or t
  misc_feature (3844)..(3844): n is a, c, g, or t
  misc_feature (3853)..(3853): n is a, c, g, or t
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaacaaaaaaaaaacaaacaaaaaaaaaaaaaaatgtgtgtcggcgcgcgcgccncgggcccctggaaaaagnttttaaagaacaatcgggtggggccgccgcggggccccaatagggaaagggaaacggggccaaagcgggntcccaagaggaaaaccggggcaaagaaaanggngcnggggnttncncccacattnaaaaaacggccgggggggaaacccga

SEQ ID NO: 452638 - DNA, 3637 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgtccacggaccgagcgattgctcaagaatgatacaaagcatcagagacatgcgcagtctgcttgtcaactttcaacaactcttgtgtgttcccagcaccggaaggtctcagacttcatattccactcgtgcc

SEQ ID NO: 452639 - DNA, 3105 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttgcttgcttttttgtttttttagagatggggtcttgctatgttgcccaggctggtcttgaactcctgggctcaagtgatgctcccacctcaacctcccaaagcgctgggagtacaggcatgggccactgctcccaacctaccctgctttttttttcttttttttttttaataaagaatgtggtttatacccagttgatgaggaaaaactc

SEQ ID NO: 452640 - DNA, 2450 bp, Homo sapiens
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcaccccacccccccaccctccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgagtaggtcgtagcggaatcgggggtatgatgttcgaattcataagaacaggaaggttaaaagtagggtcttggtgacaaaatatgtagtgtagagtt

SEQ ID NO: 452641 - DNA, 3697 bp, Homo sapiens
tcatgcttgtgttggtgtgatggtctctgtgggtgggtggatgctttgggcgttgaaatctagaaatcctgttgctcagtttctagatgaagtcatgagcaaggccatcagtggagctctggccccgcccccaatgtgcagaagggccgggagcaaggcctggagttttcatgtgttttcagacccaggtttaggtgctctcttctcactgaaataactaagtgctctccactggcatcgagccctttccacaagtttttaaggctcttaacccacactttcactcctctgctactagtcttcagtgttgttaacagcaagagaaaattgggtttgtttaaaaatctacttctctgaggtggcacagttgctagctgggactacaggtgtctgccgccacgcctggctaatttttttgtatttttagtagagacggggtttcaccatgttggtcaggatggtctcgatttcctgacctcgtgatccgcctgtctcggcctcccaaagtgctgggattacaggcgtgagccaccacgcctggcctataagatacggtaaaaaaaaaaaactgtgacccctttgtcactaagggagaaagaaattaagtattgtcaaagttctataaagaatggaaatgtatgatattatacttcaaaggaatttgatgttgaaattttaaagaaaatttgtcatgttgatgagaagcttcactttcctgggaacttcattcgttttagggcatgagataaaagtcctggctaggggagccataggtctgttgtacaaggaatttgctttctaaacaagttgtaacttgccctaaggtccctgttggagcactaagaggtgacacaggccagagacaacgtttcgtttccccttccctgcaagctgggatcagccctgtgttttctcctttcagctgaagtgagcgaaggttctcagtgctggcaaaagagcccactttctaaaaggacttgggaagaaagctgctgggaacttgcttattaaaaagttccttagaattaaggtatctacccactgttttcgcacctttcaccttcctgggctttcctgccctccagcattcttctctagagaggttcctagcccgctcagcgcgagcgtctccagtaggtaatagcagctgaacgtgggttttccacggacttcaggcttggaggtgccatatacaagcacacttcttccttcccctggcttctccatgccaccacccactttaaagatgtaaactcagtagatttttcatccagtgaacggtcatcttcacatcgaaaggtgaaggccaccactgttctcaatgccaagcaacagaacgttctgagatggccgttcttccttgcacagcagctacggcaggttgttctgcagccaccccttagagggggctcttcgttttacctttgtacagttcttgtgtttacacatttgggccaaacagctttcagcaagggcatgtgtccacagctgatgggcagttaagaaccagcctgagctgaaggctagtaataccgtgctgtaggctctttaaaaggaaagcctggcataaacccagcatggaaaggaacattatcagttatctcaaattttgtctgccagggacaagaccctgttcattcttttgcccttttcagaactgtgagcttcaagtattcttgcttctctgtaaagggaagacatctcccttctctgaaatccttcaacaaaagaaaaggctcttggcagggtaggggagtcagtagctcaacactagatcatccctagagatggggcaagtttctgtctgaacacgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaatgaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaaccttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcac

SEQ ID NO: 452642 - DNA, 3581 bp, Homo sapiens
tgacacatcaacattaacttttcctgaaaagaagagtttgcctaacatggtcctaaagaagcttggaatttataagactttcctttataagatatagtgggggtttttttgggtggaggggggttgttttttgttttttgttttcaagacagagtctcgctctgttgtccaggctggagtgtagtggcatgatctcggctcactgcaacctctgcctcccaggttcatgccattctcctgcctcagcctcccgagtagctgggactacaggtgtctgccgccacgcctggctaatttttttgtatttttagtagagacggggtttcaccatgttggtcaggatggtctcgatttcctgacctcgtgatccgcctgtctcggcctcccaaagtgctgggattacaggcgtgagccaccacgcctggcctataagatacggtaaaaaaaaaaaactgtgacccctttgtcactaagggagaaagaaattaagtattgtcaaagttctataaagaatggaaatgtatgatattatacttcaaaggaatttgatgttgaaattttaaagaaaatttgtcatgttgatgagaagcttcactttcctgggaacttcattcgttttagggcatgagataaaagtcctggctaggggagccataggtctgttgtacaaggaatttgctttctaaacaagttgtaacttgccctaaggtccctgttggagcactaagaggtgacacaggccagagacaacgtttcgtttccccttccctgcaagctgggatcagccctgtgttttctcctttcagctgaagtgagcgaaggttctcagtgctggcaaaagagcccactttctaaaaggacttgggaagaaagctgctgggaacttgcttattaaaaagttccttagaattaaggtatctacccactgttttcgcacctttcaccttcctgggctttcctgccctccagcattcttctctagagaggttcctagcccgctcagcgcgagcgtctccagtaggtaatagcagctgaacgtgggttttccacggacttcaggcttggaggtgccatatacaagcacacttcttccttcccctggcttctccatgccaccacccactttaaagatgtaaactcagtagatttttcatccagtgaacggtcatcttcacatcgaaaggtgaaggccaccactgttctcaatgccaagcaacagaacgttctgagatggccgttcttccttgcacagcagctacggcaggttgttctgcagccaccccttagagggggctcttcgttttacctttgtacagttcttgtgtttacacatttgggccaaacagctttcagcaagggcatgtgtccacagctgatgggcagttaagaaccagcctgagctgaaggctagtaataccgtgctgtaggctctttaaaaggaaagcctggcataaacccagcatggaaaggaacattatcagttatctcaaattttgtctgccagggacaagaccctgttcattcttttgcccttttcagaactgtgagcttcaagtattcttgcttctctgtaaagggaagacatctcccttctctgaaatccttcaacaaaagaaaaggctcttggcagggtaggggagtcagtagctcaacactagatcatccctagagatggggcaagtttctgtctgaacacgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaatgaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaaccttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcac

SEQ ID NO: 452643 - DNA, 3832 bp, Homo sapiens
tcatgcttgtgttggtgtgatggtctctgtgggtgggtggatgctttgggcgttgaaatctagaaatcctgttgctcagtttctagatgaagtcatgagcaaggccatcagtggagctctggccccgcccccaatgtgcagaagggccgggagcaaggcctggagttttcatgtgttttcagacccaggtttaggtgctctcttctcactgaaataactaagtgctctccactggcatcgagccctttccacaagtttttaaggctcttaacccacactttcactcctctgctactagtcttcagtgttgttaacagcaagagaaaattgggtttgtttaaaaatctacttctctgaggtggcacagttgcgtagctgtagtcccagctactcaggaggctgaggtagtaggattgcttgagcccgggagtgtagtggcatgatctcggctcactgcaacctctgcctcccaggttcatgccattctcctgcctcagcctcccgagtagctgggactacaggtgtctgccgccacgcctggctaatttttttgtatttttagtagagacggggtttcaccatgttggtcaggatggtctcgatttcctgacctcgtgatccgcctgtctcggcctcccaaagtgctgggattacaggcgtgagccaccacgcctggcctataagatacggtaaaaaaaaaaaactgtgacccctttgtcactaagggagaaagaaattaagtattgtcaaagttctataaagaatggaaatgtatgatattatacttcaaaggaatttgatgttgaaattttaaagaaaatttgtcatgttgatgagaagcttcactttcctgggaacttcattcgttttagggcatgagataaaagtcctggctaggggagccataggtctgttgtacaaggaatttgctttctaaacaagttgtaacttgccctaaggtccctgttggagcactaagaggtgacacaggccagagacaacgtttcgtttccccttccctgcaagctgggatcagccctgtgttttctcctttcagctgaagtgagcgaaggttctcagtgctggcaaaagagcccactttctaaaaggacttgggaagaaagctgctgggaacttgcttattaaaaagttccttagaattaaggtatctacccactgttttcgcacctttcaccttcctgggctttcctgccctccagcattcttctctagagaggttcctagcccgctcagcgcgagcgtctccagtaggtaatagcagctgaacgtgggttttccacggacttcaggcttggaggtgccatatacaagcacacttcttccttcccctggcttctccatgccaccacccactttaaagatgtaaactcagtagatttttcatccagtgaacggtcatcttcacatcgaaaggtgaaggccaccactgttctcaatgccaagcaacagaacgttctgagatggccgttcttccttgcacagcagctacggcaggttgttctgcagccaccccttagagggggctcttcgttttacctttgtacagttcttgtgtttacacatttgggccaaacagctttcagcaagggcatgtgtccacagctgatgggcagttaagaaccagcctgagctgaaggctagtaataccgtgctgtaggctctttaaaaggaaagcctggcataaacccagcatggaaaggaacattatcagttatctcaaattttgtctgccagggacaagaccctgttcattcttttgcccttttcagaactgtgagcttcaagtattcttgcttctctgtaaagggaagacatctcccttctctgaaatccttcaacaaaagaaaaggctcttggcagggtaggggagtcagtagctcaacactagatcatccctagagatggggcaagtttctgtctgaacacgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaatgaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaaccttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcac

SEQ ID NO: 452644 - DNA, 1907 bp, Homo sapiens
gtctcgcaccccgacgtggcttgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaatgaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaaccttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcac

SEQ ID NO: 452645 - DNA, 1582 bp, Homo sapiens
tctgactctagaggttaccaactacacagctattcccagcaactatagcagctatccaagggagacttggtttgaaaggcacagttctgggatcagggtctaaatgtgcagtttctgagaaccttcaagaccactcactgggcagggctctgtggagcactggagaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaaccttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcac

SEQ ID NO: 452646 - DNA, 3643 bp, Homo sapiens
tcatgcttgtgttggtgtgatggtctctgtgggtgggtggatgctttgggcgttgaaatctagaaatcctgttgctcagtttctagatgaagtcatgagcaaggccatcagtggagctctggccccgcccccaatgtgcagaagggccgggagcaaggcctggagttttcatgtgttttcagacccaggtttaggtgctctcttctcactgaaataactaagtgctctccactggcatcgagccctttccacaagtttttaaggctcttaacccacactttcactcctctgctactagtcttcagtgttgttaacagcaagagaaaattgggtttgtttaaaaatctacttctctgaggtggcacagttgctagctgggactacaggtgtctgccgccacgcctggctaatttttttgtatttttagtagagacggggtttcaccatgttggtcaggatggtctcgatttcctgacctcgtgatccgcctgtctcggcctcccaaagtgctgggattacaggcgtgagccaccacgcctggcctataagatacggtaaaaaaaaaaaactgtgacccctttgtcactaagggagaaagaaattaagtattgtcaaagttctataaagaatggaaatgtatgatattatacttcaaaggaatttgatgttgaaattttaaagaaaatttgtcatgttgatgagaagcttcactttcctgggaacttcattcgttttagggcatgagataaaagtcctggctaggggagccataggtctgttgtacaaggaatttgctttctaaacaagttgtaacttgccctaaggtccctgttggagcactaagaggtgacacaggccagagacaacgtttcgtttccccttccctgcaagctgggatcagccctgtgttttctcctttcagctgaagtgagcgaaggttctcagtgctggcaaaagagcccactttctaaaaggacttgggaagaaagctgctgggaacttgcttattaaaaagttccttagaattaaggtatctacccactgttttcgcacctttcaccttcctgggctttcctgccctccagcattcttctctagagaggttcctagcccgctcagcgcgagcgtctccagtaggtaatagcagctgaacgtgggttttccacggacttcaggcttggaggtgccatatacaagcacacttcttccttcccctggcttctccatgccaccacccactttaaagatgtaaactcagtagatttttcatccagtgaacggtcatcttcacatcgaaaggtgaaggccaccactgttctcaatgccaagcaacagaacgttctgagatggccgttcttccttgcacagcagctacggcaggttgttctgcagccaccccttagagggggctcttcgttttacctttgtacagttcttgtgtttacacatttgggccaaacagctttcagcaagggcatgtgtccacagctgatgggcagttaagaaccagcctgagctgaaggctagtaataccgtgctgtaggctctttaaaaggaaagcctggcataaacccagcatggaaaggaacattatcagttatctcaaattttgtctgccagggacaagaccctgttcattcttttgcccttttcagaactgtgagcttcaagtattcttgcttctctgtaaagggaagacatctcccttctctgaaatccttcaacaaaagaaaaggctcttggcagggtaggggagtcagtagctcaacactagatcatccctagagatggggcaagtttctgtctgaacacgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaatgaagaaggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaaccttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcac

SEQ ID NO: 452647 - DNA, 3728 bp, Homo sapiens
  misc_feature (2965)..(2965): n is a, c, g, or t
  misc_feature (2969)..(2971): n is a, c, g, or t
  misc_feature (3012)..(3013): n is a, c, g, or t
  misc_feature (3023)..(3023): n is a, c, g, or t
  misc_feature (3029)..(3029): n is a, c, g, or t
tcatgcttgtgttggtgtgatggtctctgtgggtgggtggatgctttgggcgttgaaatctagaaatcctgttgctcagtttctagatgaagtcatgagcaaggccatcagtggagctctggccccgcccccaatgtgcagaagggccgggagcaaggcctggagttttcatgtgttttcagacccaggtttaggtgctctcttctcactgaaataactaagtgctctccactggcatcgagccctttccacaagtttttaaggctcttaacccacactttcactcctctgctactagtcttcagtgttgttaacagcaagagaaaattgggtttgtttaaaaatctacttctctgaggtggcacagttgctagctgggactacaggtgtctgccgccacgcctggctaatttttttgtatttttagtagagacggggtttcaccatgttggtcaggatggtctcgatttcctgacctcgtgatccgcctgtctcggcctcccaaagtgctgggattacaggcgtgagccaccacgcctggcctataagatacggtaaaaaaaaaaaactgtgacccctttgtcactaagggagaaagaaattaagtattgtcaaagttctataaagaatggaaatgtatgatattatacttcaaaggaatttgatgttgaaattttaaagaaaatttgtcatgttgatgagaagcttcactttcctgggaacttcattcgttttagggcatgagataaaagtcctggctaggggagccataggtctgttgtacaaggaatttgctttctaaacaagttgtaacttgccctaaggtccctgttggagcactaagaggtgacacaggccagagacaacgtttcgtttccccttccctgcaagctgggatcagccctgtgttttctcctttcagctgaagtgagcgaaggttctcagtgctggcaaaagagcccactttctaaaaggacttgggaagaaagctgctgggaacttgcttattaaaaagttccttagaattaaggtatctacccactgttttcgcacctttcaccttcctgggctttcctgccctccagcattcttctctagagaggttcctagcccgctcagcgcgagcgtctccagtaggtaatagcagctgaacgtgggttttccacggacttcaggcttggaggtgccatatacaagcacacttcttccttcccctggcttctccatgccaccacccactttaaagatgtaaactcagtagatttttcatccagtgaacggtcatcttcacatcgaaaggtgaaggccaccactgttctcaatgccaagcaacagaacgttctgagatggccgttcttccttgcacagcagctacggcaggttgttctgcagccaccccttagagggggctcttcgttttacctttgtacagttcttgtgtttacacatttgggccaaacagctttcagcaagggcatgtgtccacagctgatgggcagttaagaaccagcctgagctgaaggctagtaataccgtgctgtaggctctttaaaaggaaagcctggcataaacccagcatggaaaggaacattatcagttatctcaaattttgtctgccagggacaagaccctgttcattcttttgcccttttcagaactgtgagcttcaagtattcttgcttctctgtaaagggaagacatctcccttctctgaaatccttcaacaaaagaaaaggctcttggcagggtaggggagtcagtagctcaacactagatcatccctagagatggggcaagtttctgtctgaacacgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaatgaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttagggggngggnnnggggggggggggggggggggggggggggggggtgggcgggnncggggggggngggggngggggggggggggggggggggagaggcgggggcgggggaggaggaggggggggggcggggggaagggaagggggggagggtgagaggggggccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaaccttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcac

SEQ ID NO: 452648 - DNA, 1363 bp, Homo sapiens
cagtttacagcgtcagggcagtttacagcgtcagggcagtttacagcgtcagggcagtttacagcgtcagggcagtttacagcgtcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaaccttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcac

SEQ ID NO: 452649 - DNA, 1184 bp, Homo sapiens
tcatgcttgtgttggtgtgatggtctctgtgggtgggtggatgctttgggcgttgaaatctagaaatcctgttgctcagtttctagatgaagtcatgagcaaggccatcagtggagctctggccccgcccccaatgtgcagaagggccgggagcaaggcctggagttttcatgtgttttcagacccaggtttaggtgctctcttctcactgaaataactaagtgctctccactggcatcgagccctttccacaagtttttaaggctcttaacccacactttcactcctctgctactagtcttcagtgttgttaacagcaagagaaaattgggtttgtttaaaaatctacttctctgaggtggcacagttgcgtagctgtagtcccagctactcaggaggctgaggtagtaggattgcttgagcccgggaggtcgaggctgcaatcagtcatgatcgtgtcactgcactccagcctgggtgacaaagcaaggccccatatcagatatagatatacttatcagaccccccctgaccatttagattggcagtgctttgagaaatgcactatgacctttctgtgtcaatgggaatatacagaaggaacattcgggaccccgctgtcccccacagcctcattgttgtctccaggacactgctgggtcacacgaatgctccaggacagacagggacctggagtgcatcaggatctgaccagataggagtttttgcctcgtatctgggtgctacgattttgtgccgttctctgaggtccaccacctgcccttcctggcatggtttccttcgtgaccatccctgctgcccctgggggtggaccccactggcccttctgcagacagctccctgccttctgccctccagggggttctggccagagtccatgcttggagacaggatcatctgccttcagccctcacagtgctttaaattaaagcaagtttgcccataggacaaaagagcatttgattcccttttttctgtcacatatcccttgaggctggacttcaggaatcctggaaaattaatatgagtgcagcatgtgaggggtcagagacaggccagcagggcgtctgcattcctccctgccacaggtctctccccagaggctggtttagtgtagggtattgccaggaaacggactgaggctgctttgctaagagctcctg

SEQ ID NO: 452650 - DNA, 2108 bp, Homo sapiens
tagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacaactcctgctccattgcatttgatttgatg

SEQ ID NO: 452651 - DNA, 2149 bp, Homo sapiens
tagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacaataaataaattccctcttcccatttctttgtaatgtatactccattctgactttgtccttctcgatctcctttacctttaataacatggggcccgccttgcccacggctcttttatctcggacc

SEQ ID NO: 452652 - DNA, 2079 bp, Homo sapiens
tagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacaca

SEQ ID NO: 452653 - DNA, 2025 bp, Homo sapiens
tagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacaca

SEQ ID NO: 452654 - DNA, 5262 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgttt

SEQ ID NO: 452655 - DNA, 2942 bp, Homo sapiens
gtctagaggatcccgaatgcggcaggacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgttt

SEQ ID NO: 452656 - DNA, 5136 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgttt

SEQ ID NO: 452657 - DNA, 4628 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcattta

SEQ ID NO: 452658 - DNA, 2266 bp, Homo sapiens
ttttttgggttgatctacatctacatctaaatctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgttt

SEQ ID NO: 452659 - DNA, 3933 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacaatccagcagcccaggaggtcgacgcggccgcgaatttagtagtagtaggcggccgc

SEQ ID NO: 452660 - DNA, 3381 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctttcgatgtgccaagtgtggcaaagg

SEQ ID NO: 452661 - DNA, 1182 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacaagccatccttttgcctcagtatcccaactagctgggtctacaggcatgagccaccatgcccgggtaattaacaaatttttttttgtagagatgggggtctcactatgttgctctggctgatctcaaattcctggcctcaagtgatctttctgccacagctttttaaagtgctaggattacaggcatgagccaccatgcctaatatagagtgtaatatcactttcaagtcttattcctagacccatttattgacctgtggcctaaataactcatatgagatctctgaagcttcct

SEQ ID NO: 452662 - DNA, 225 bp, Homo sapiens
cgctgtgaaaacaccgagggaagtttcttgtgcatttgcccagcaggatttatggccagtgaggagggtactaactgcataggtaatggcagcattcttcctgcttacaaattcttagatctgagtttttagatcccctaagactatcatcagttcagtgcttatccagacaacccagaattttttattaaacaattatcatgacagcagtctgctagatcccag

SEQ ID NO: 452663 - DNA, 428 bp, Homo sapiens
caacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacaggtaaacatcatcaccgagcctgctttagcagtgtcttacagatatggtatcattttaacaagaaagccagacttgataaaaatgcttttttaaaaaaaaggctttgacaaactatgacttgtggccatatttttgtaaataaagttttattgccacactcatagccacacttattcatttacatactgtctatgcccattttcatgcgatgactgcagaattaaatagtccagtgagatcata

SEQ ID NO: 452664 - DNA, 5105 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtaga

SEQ ID NO: 452665 - DNA, 5174 bp, Homo sapiens
caggagagcagtccactgaaggttctttccctttaagatatgtgcaggatcaagttgcggcaccttttcagctgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgttt

SEQ ID NO: 452666 - DNA, 2524 bp, Homo sapiens
actagaggatacccatatcatagtaagtcacaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgttt

SEQ ID NO: 452667 - DNA, 2126 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaaatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgttt

SEQ ID NO: 452668 - DNA, 1330 bp, Homo sapiens
ccggtcctctccctaggtatccgtagacgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgttt

SEQ ID NO: 452669 - DNA, 3102 bp, Homo sapiens
ctctttccttaaacctgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagcttctgtttgaggagctgaagcctcgttgacaccagggctgacctgcccggctctaagcagggctaaataactcccacatagctgaaggaaggagggcccttccctgatttcccgtgacttggagaagtgtcagcatctggtcgtagttaatgaaccacaatgaagaggcaaactctgtcaacatgaattgtctttaagtgtagcatggcagcttctatagcaataaaaatggcaccactggctcc

SEQ ID NO: 452670 - DNA, 515 bp, Homo sapiens
gaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaaggtaagcttttttcattccgcccatttgccagacctctgttaacctgccaaacccacatagaagtcaaggatctgcgggtggccagggctggtattgaaacagaaaggagtacatgatttgtggcctgagaaatggcagtagagacagaatgtgggcccaggtatgtagctgcagtactttctaggccatagagagttagtgtctaggaaataagaaaataaaaaggagcccattcttctctagtgattctttaccaccaagagctaataaatgtgcatggtactgttctgacaaggcctgggaaatagaaag

SEQ ID NO: 452671 - DNA, 3743 bp, Homo sapiens
gagaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccctcccacctttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtg

SEQ ID NO: 452672 - DNA, 3956 bp, Homo sapiens
gagaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccctcccacctttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgca

SEQ ID NO: 452673 - DNA, 513 bp, Homo sapiens
  misc_feature (166)..(166): n is a, c, g, or t
tcattcatcttttaaagctgtcctctcaataacttcagttctaagcactgaattcagtactgtgaatattccttggattgaagtttggcaatgatgcggtccaactgtctctttgcttcacactgtgggaaattgctcatgtcataatattgaggggcaatctctnatactccgaattcggcacggaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtg

SEQ ID NO: 452674 - DNA, 518 bp, Homo sapiens
gagataatgcaggctttatatcttcattgcagttggagaatctgatgcgactttgcttggttaacactttatgactagcttttcgtctgtctttgcagtatgatcatagtcaccagcaagatgcctttactgacagaactggtcttgtgtggtttctggaaatcagaaggaaaactcgagagctgcactgtctaataaaacttcctgcattgatggaacgttcagttctcatttcaatagcaatgtcaaagtttcatagctagctctcataaataagagaatgatttgaatttggaaaacttttcttcctcttcattttcagtctctcctctattgaaccaccagaatccttacaaaataataatgttgaatatttactgatttttttttttttatgagacggagtctcgctctgttggaatgttctatgccttatgcacatatatgctcatttaaacctcattttgagttttcttacatgtgaattcaactccatgtcactctggggaaaaaaagaa

SEQ ID NO: 452675 - DNA, 3402 bp, Homo sapiens
attatggtttatgttaaaaatccagcattgagttttgagaagccatattatttaaagaagtaatgttctaattttgctgaaatgtatatagaatcatatcatttccctcttttaaatttcaaaaagcaatgaaagttgttttagttagaatgtctgctagtactcttaagaacatactgatttaaaatttgtacctttgtttgtgtttcattcagggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgtaaaaaaaaaaaaaaagatcgatgatagaaaagtataaagaagaaaatagcaagcaggtcaaatactactatccaaaatgatcacttttaatattttagtatgctttctgctagatctttttctacatattgaagtatattttacataattgaaatcatactatatattcaattttatatcatgctttttcacttaatataagcattatcccaacatcattaaaacttcatgagcaacattttaatgactgtataataatatgctgttgtataaatttaccataatcttttgaagtattctgtcattaaacatttggctgtttct

SEQ ID NO: 452676 - DNA, 3250 bp, Homo sapiens
  misc_feature (2314)..(2314): n is a, c, g, or t
gagaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccctcccacctttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatggaacacaagggagtgtgcagntggagacagccagggaccacatgtacacggcctggtacgctttgacaaggactttggatcttactctgagtatgagagaaagcactgggaagtttcaaggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtg

SEQ ID NO: 452677 - DNA, 729 bp, Homo sapiens
aaatttactaaatttgtttcttaggctgcattcttagagggattactcagctgggatacacagatctgaataaaagttttattattacagattcttttttcaaactggaacttattgtgtaaatagactctagtaatcataagctttaaattaaaattactgcatttggagaagtgtatacttttcaaagtgaccttagtgatttaaacattattcttttttatcattatcataaaagttttatacagagcttttttcctctaggttgctgcttcatatctgattcaggttagtagttactggaaattaactttgacacttaaattgtgtggaatgagaataagtcttaatctgaattctagccaaaaaatttaaaagcttagttcactcactagcaccattgtagtataatatagctaatgttcttctgttacttttagtacaagattcgggtcttcctgaaccatagaaataagagaaaaattctccagaataaagttttgaattacatcgattggcttaggaaagcacgttttctccctcatctgttttcttttttggaatgcagggatatcttggctagtaattctctactggttttatgattgctaatatattcaaaaccaaaacaaactttattatgttatatatacaaaaatgtctgtatttttttcaaacctagccttatttagtccttttcggtgcagaaaaaattaaaaagaagagaag

SEQ ID NO: 452678 - DNA, 5480 bp, Homo sapiens
gagaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccctcccacctttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgtaaaaaaaaaaaaaaagatcgatgatagaaaagtataaagaagaaaatagcaagcaggtcaaatactactatccaaaatgatcacttttaatattttagtatgctttctgctagatctttttctacatattgaagtatattttacataattgaaatcatactatatattcaattttatatcatgctttttcacttaatataagcattatcccaacatcattaaaacttcatgagcaacattttaatgactgtataataatatgctgttgtataaatttaccataatcttttgaagtattctgtcattaaacatttggctgtttct

SEQ ID NO: 452679 - DNA, 3725 bp, Homo sapiens
gtaatttctttattggcttttccaggaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgggaagtgccagacacagcttcagaatgtgactccttaaattcttccattggaaggaaacagtctcctcctttaagcctcgagatataccaaacattatctccgcgaaagatatcaagagatgaggtgtccctagaggattcctcccgaggggattcgcctgtaactgtggatgtgtcttggggttctcccgactgtgtaggtctgacagaaactaagagtatgatcttcagtcctgcaagcaaagtgtacaatggcattttggagaaatcctgtagcatgaaccagctttccagtggcatcccggtgcctaaacctcgccacacatcatgttcctcagctggcaacgacagtaaaccagttcaggaagccccaagtgttgccagaataagcagcatcccacatgacctttgtcataatggagagaaaagcaaaaagccatcaaaaatcaaaagcctttttaagaagaaatctaagtgaactggctgacttgatggaatcatgttcaagtggcatctgtaaactattatcccccaccctccactccccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaatatcaagattaacaaatataaatttatggtgcatttagattgcgttgtattaatttataaagtatggtgttcattaaattggtgggttgtataagggtagcttttgttgttaaaaaaacagtagagagttaagttccatatagcaacaaagtatgttaacatctagggagtttctgcttataccactttaaaaatatgcaatcataagtgatttggttactgcaatgcagatggatgtttggatgaacaactgatacattttagttagaatgctttttcagcattatggctaaaatatatgtctaacccagtgctatttaggtgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgtaaaaaaaaaaaaaaagatcgatgatagaaaagtataaagaagaaaatagcaagcaggtcaaatactactatccaaaatgatcacttttaatattttagtatgctttctgctagatctttttctacatattgaagtatattttacataattgaaatcatactatatattcaattttatatcatgctttttcacttaatataagcattatcccaacatcattaaaacttcatgagcaacattttaatgactgtataataatatgctgttgtataaatttaccataatcttttgaagtattctgtcattaaacatttggctgtttct

SEQ ID NO: 452680 - DNA, 2713 bp, Homo sapiens
gagaggcgggggattggtatgcgagcgaatgtgcgaggggagggaggcgtcccggcggagcgtggtactacgaccagcgcgggccggagggggcggggggatgcgccgcggcggcggcggcgcgggagctggggttggtgtttggcggcgccagagcagcggatcccggtctcgccgcagcagcagcgcgggtgtcgtgcaccgcctgaagacgccgtacctttctaccctcccacctttttttttttttttttaaataaccggaaccaatgaacgcagccgggatcagagctccggaggccgccggtgccgatgggaccaggctggcgcccggcgggagcccgtgtctgaggcggcgggggcggccggaggagtcgccggcggcggtggtggcgcctcgcggagccggcgagctgcaggcggccggggcgccgctgcgctttcacccggcttctcctcggcgccttcatcccgcctcgactcctggcccagcgtggggctggctgctgcggcggcggcgctgggctgcgttgctggtgctcgggctgctggtagccggagcggcggacggatgcgagcttgtgccccggcacctccgcgggcggcgggcgactggctctgccgcaactgccgcctcctctcccgccgcggcggccggcgatagcccggcgctcatgacagatccctgcatgtcactgagtccaccatgctttacagaagaagacagatttagtctggaagctcttcaaacaatacataaacaaatggatgatgacaaagatggtggaattgaagtagaggaaagtgatgaattcatcagagaagatatgaaatataaagatgctactaataaacacagccatctgcacagagaagataaacatataacgattgaggatttatggaaacgatggaaaacatcagaagttcataattggacccttgaagacactcttcagtggttgatagagtttgttgaactaccccaatatgagaagaattttagagacaacaatgtcaaaggaacgacacttcccaggatagcagtgcacgaaccttcatttatgatctcccagttgaaaatcagtgaccggagtcacagacaaaaacttcagctcaaggcattggatgtggttttgtttggacctctaacacgcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaagagaggcttgaaaaggcacaggaagaaaacagaaatgttgctgtagaaaagcaaaatttagagcgcaaaatgatggatgaaatcaattatgcaaaggaggaggcttgtcggctgagagagctaagggagggagctgaatgtgaattgagtagacgtcagtatgcagaacaggaattggaacaggttcgcatggctctgaaaaaggccgaaaaagaatttgaactgagaagcagttggtctgttccagatgcacttcagaaatggcttcagttaacacatgaagtagaagtgcaatactacaatattaaaagacaaaacgctgaaatgcagctagctattgctaaagatgaggcagaaaaaattaaaaagaagagaagcacagtctttgggactctgcacgttgcacacagctcctccctagatgaggtagaccacaaaattctggaagcaaagaaagctctctctgagttgacaacttgtttacgagaacgactttttcgctggcaacaaattgagaagatctgtggctttcagatagcccataactcaggactccccagcctgacctcttccctttattctgatcacagctgggtggtgatgcccagagtctccattccaccctatccaattgctggaggagttgatgacttagatgaagacacacccccaatagtgtcacaatttcccgggaccatggctaaacctcctggatcattagccagaagcagcagcctgtgccgttcacgccgcagcattgtgccgtcctcgcctcagcctcagcgagctcagcttgctccacacgccccccacccgtcacaccctcggcaccctcaccacccgcaacacacaccacactccttgccttcccctgatccagatatcctctcagtgtcaagttgccctgcgctttatcgaaatgaagaggaggaagaggccatttacttctctgctgaaaagcaatgtatgatcatagtcaccagcaagatgcctttactgacagaactggtcttgtgtggtttctggaaatcagaaggaaaactcgagagctgcactgtctaataaaacttcctgcattgatggaacgttcagttctcatttcaatagcaatgtcaaagtttcatagctagctctcataaataagagaatgatttgaatttggaaaacttttcttcctcttcattttcagtctctcctctattgaaccaccagaatccttacaaaataataatgttgaatatttactgatttttttttttttatgagacggagtctcgctctgttggaatgttctatgccttatgcacatatatgctcatttaaacctcattttgagttttcttacatgtgaattcaactccatgtcactctggggaaaaaaagaa

SEQ ID NO: 452681 - DNA, 246 bp, Homo sapiens
cagggttgaggcaagcgggaggtggaagggacgcttgagagtctgccaaggctgctctgaacttggcccacctcagaagaaggcagcaaggacagaccgagtgtcacagacgccagagagcctggatttcctcaaggtccccgaccagggagctgcaggggtcaggagacaaacaaccagtcgcctcccccagcagggcagacccaagccccaagcccaagcccaaccacggcaaacacggcccga

SEQ ID NO: 452682 - DNA, 8877 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452683 - DNA, 7787 bp, Homo sapiens
  misc_feature (18)..(18): n is a, c, g, or t
ctgggtatactccccttntttgggacggcggcaacgagggaatagtttacgaactgcacgttacacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452684 - DNA, 9009 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452685 - DNA, 7891 bp, Homo sapiens
cctccttccctcctcccggttctccggttctgcttctcagaggcagccatgtgggtggtttcctgtccaccctgcaggggctcttcatatctgagcattagccataggtccctttaaaaacaaacagtggcagcctggcgcacgcagtgccacacctggcctttctcatccgccgtatcttggagatcactccacgtccctgccccgcagcagcctccttcgagttgcggttgtgctgctgtaacttgtacaggcgccgctccgtgagtatccttgcaccatctccacccgtgtgcaagtgtatcctaggggtgaaaacctagaagtagggttgctgtccgatgcggctgaactgccctgcacagaggctgtgcccacgtaggcgctccagtggtgccctcacggaatggtcaggccactctttgccaagcctgatgggtggccgaagctccccctccggctcaccttgagccccagctgctgcgggcctgaaaataaaaatgccaggcgccgatggttgaagtttagatttcttttgcgtgagagtgtgtgttttttcttaagatctttctatcacgttttccctaaaccactttcccattgccgtctctttctgtgagttgtagtgttctttaacgggcaaggaggtaaacctctgactgtgtttctcatggttttcttagttggccgttggtggtttgtaattttattttttgtgttgctttttgccacaaagggtttctttgttttgttgtttttaatgtaataatccaataacttcttgattttaattcccatccttgacaacaaaagaaccaagggcaaccaggggtggcgggtttcctccatcctccttgctgacctcccttgtctgccctcccccagataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452686 - DNA, 6072 bp, Homo sapiens
  misc_feature (22)..(22): n is a, c, g, or t
tgagaatggagcccctgggccnccaatctctcgctttcctctgtctgctccgcccctctctggcctctgcaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452687 - DNA, 4998 bp, Homo sapiens
gtcatgcacagcctgggcctccaccccactaggtgccgtgatcagagttacctgggtgggctggtacacgggctgcatggtgatgtttggggtcgtgagcccgcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452688 - DNA, 8585 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgggcggtgcggcgtggggtaccgggctcgaa

SEQ ID NO: 452689 - DNA, 7526 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgcaccagggcaccagccgctgccgccattgctcgtccatagaaatgcagtaccattcaacacctcgcagagacctggtgatacacgtacctcatccaaattaaaataccgtgacgtactcgtggtgaggaaaaaagtaaatctgaaagaaagcacgagtacatacacacataagacaagcacaaggcgccgagcaaaggcacgacaaagacagaagtgcgcgcaaacaacaaaaacaagaaagggaagaccgccacgatgacacctaagacccatacaccgaaaagaacacagagcccaaccacatggaagaagacgaaacacacaacagacaagaaggggaaagggcaggagcatagaacgaaaagaaagagaaaacaccaaacaaacaacaa

SEQ ID NO: 452690 - DNA, 2441 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgagccaggggaccagggacgtttgaaag

SEQ ID NO: 452691 - DNA, 391 bp, Homo sapiens
tgggcaggttccggtgaggtccaccaagcagggaggtgggtggcacctgtgacctggcctcacatgcccgtgcctgctgcaggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcgtcttccggggcttgtcactgtggtcaaacaagcatagtcattccctccgggctttagagttagccgttggaccgtgggctgcagaataagctgtctccattagg

SEQ ID NO: 452692 - DNA, 7786 bp, Homo sapiens
ctgtaggtgatctagaggatcccggggctcattcaggatagtggacgaactgcacgttgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452693 - DNA, 8123 bp, Homo sapiens
aaaagagtcactatggctcaggacacaaggcagggagctgccaggcctgtgcccatgctgggggagaaggaggctcgggacaaagtgggagaagtgctgggaagggctgaccggtaagggcccacgaaagttccggtgcgcaacgctgtcggcccctaccgctcatcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452694 - DNA, 6855 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452695 - DNA, 5612 bp, Homo sapiens
ttcctggtgttgcgctgctgccgggtgcagccatggcaggcctttcctcacctggggcattttccctggtgtcacatggtccctgtgtcatagtccgtggtttggctgtcatggtttggccatgcctggtgtttgaacaccgggttcttcctctcgcagtgttctacaggacgccgcagctcgtctgcatgtgtgtgcagtgttctgttcatacatattaaggaaaacggtgaaacgtttgttgttggcctttgagcattgagggggatttccattctctgacaaaggacttgacttcagccagcctcctgccttccccttgccctgtcctcacagcctcttcctcatcccagttgcctttgaggcaaagtggtgcctcttccctggcctctgagcaagtcagtgtcttgggggcaggggtgagtgggtcttacgtctgccagggccgttgagaagtggtcagtggtcccagcctgtgtggtgacagtgcaggacagtgggagggacaggcagacagccagctgcagcactaactctcctcctcgtgtgtctccccagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagcctggctccatccaacacatttgtggccccccagccggttgtggtggccagcccagccaagctgcaggctgcagctaccctgaccgaagtggccaatggcatcgagtccctgggtgtgaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaaagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgcgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcaggaaaccagtaaagacagctctggcaccaagccagccaacaagcggcccatgtcctctccagaaatgaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452696 - DNA, 7776 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctgatttccaatctgggcaaagtgatgtcggtggtccagaccaaaccagttcagacttcagcagtcacaggccaggcgtccacgggtcctgtgactcagatcatccagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccgcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcatcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccaaactaggtgt

SEQ ID NO: 452697 - DNA, 2956 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctggataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcgtcttccggggcttgtcactgtggtcaaacaagcatagtcattccctccgggctttagagttagccgttggaccgtgggctgcagaataagctgtctccattaggggcgtcatggcctcaggtgagagctgcaggctcagcctcctcccttgcctgttaaaggaagggggaaccaagctg

SEQ ID NO: 452698 - DNA, 1992 bp, Homo sapiens
cggctcccagggaggaggcatgagcgccctgccgttaccgcttcttctgccgtacagttgccgcttcggggcctaactctagctctttgaagcggctcctgtgggaaggagtcataaggcgggaagtgaggatcggacaccgccttgagtttggtgtgcagtggaagaactgacctaggaggaagagaataggggggaacggggagctagtctcaagatggcggctcccacggcggcaggcgcagcctgagcagcagaggcggactaaggggagaggcgcgagacttcacaagccgtacggcgcgagcccccaaacggccctcgagagctcgagctggttccaccggcctccggcccgcctccattcgttaggtgtgtcgaggctgtttcgggagcggcggctgcactaaggcgctgggcggggaagcgggacggtctcaagatggcggctcccacaattgtggtctgagcgccggcggggctgcgacgaccgcggcgcttgtggctcctttccacccgccccggaagccggccagtgctggggacttgggggtgtgggaaccgggccggggctccgccatttccggcgggggagggctacgactgaggaagggaggagagagaggcggctcaagatggcggctcccagggcctcccgcccgagcttgtaagcgggagcgcccggacaagtagtcggggcgacgggactcagcggcctccagcttcttgagcctaggcgctcgacagtttcgggcggctcttgcggagacggggtgagcgagaagaaagggaagagccaaagggaaggagggcagttaagatggcggcctccatggagtcgtctaccgctgtgtgagaaaccgcttctccgtgagagctgccttagacgaaagggggtgtgtgaaaggaattgaggggctcccttcccgcttgttgacttctccccaccgcaccctttcccggaactatggcttcggccgtgtcgcccgccaacttgccagcggtgcttctgcagccccgctggaagcgagtggtgggctggtcgggtccggtgccacggccccgccacggccaccgcgccgtggccatcaaggagctcatcgtggtgtttggcggcggcaacgagggaatagtggacgaactgcacgtgtacaacacggcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattgacaccctgacgtggaataagcccagtctcagcggggtggcgcctcttcctcgcagtctccactcggcaaccaccatcggaaataaaatgtacgtgtttggtggctgggtgcctctcgtcatggatgacgtcaaagtggccacacacgagaaggagtggaagtgtaccaacacgctggcttgtctcaacctgggtatggcctcctcgggctccgagtggcctgtgggaggctgcaggaggctggcccttctcagcctaagagctgtgtggggtgtgcggggagcaagctgggcccccggctccctttggaatcc

SEQ ID NO: 452699 - DNA, 298 bp, Homo sapiens
caacacccaggaccttcttgctccagcaaggcacctcgctcacccccggccatttcctcctccaccacaagttgccccgggtccctagtggtggccttctcatcccacggttcagtctccaggtcttgattttgcaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaag

SEQ ID NO: 452700 - DNA, 4028 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaa

SEQ ID NO: 452701 - DNA, 533 bp, Homo sapiens
agtccgtgtgagcacactgacacgtcccttgtgcttgtgctgctgctgatggccggctctgtggtctctacaggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacggtgaggctcggcttttctcacttcctgagagtcgcaccaggatggaaggggtgtttatgctcaagtttcctgacgcttggctttggctaggaactgatcccaggtagacatctgcttgcttcttcaagagggctttgcaccttggccaaagggtccttggtcccagggcagggttccctgtcactgcctcctatgttaacttctcccgtgatttaaatagacacatcttaaacacgtagatgttttgccgccctcacctgggcgacagaacgagaccccatctcaaaaaaaaa

SEQ ID NO: 452702 - DNA, 268 bp, Homo sapiens
ggctcagactgatacgttgatatcgaatgcgcgcgtcgtgcgctcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaa

SEQ ID NO: 452703 - DNA, 4111 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452704 - DNA, 4085 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcataaaaacaacatcaaaaacaaacaaacaaaaaaaaa

SEQ ID NO: 452705 - DNA, 2733 bp, Homo sapiens
ggctgggtgtaatcggacgaggctacatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452706 - DNA, 2743 bp, Homo sapiens
aaaagtggcagctcacactcatgcccttgagccatagctgcgtgggtgcaggtctggggctgctggccctgcagtgacagcctgcctgtttgcaggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452707 - DNA, 2652 bp, Homo sapiens
tagctgtcttgggcagaggggctttttgcagttttcaagggcactctgtttttctccatgctgacccgctttagcagcccagtttccagagtctcttcaacgcattgattagtccaggcgcctcaggcacacccaacgctgatttgtccccccaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452708 - DNA, 2065 bp, Homo sapiens
  misc_feature (2)..(2): n is a, c, g, or t
tnggcaccgaaggcctgaaggtgcaggcttcctggcagaagatggtgaactgcagtggccagtgccctgtcctccaagataccactgagcctcttgcccatgattcagaggtatctggaggacaaggtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452709 - DNA, 4010 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452710 - DNA, 1792 bp, Homo sapiens
acactagaaggcccggttatcggacgaggccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452711 - DNA, 3773 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcataaaaacaacatcaaaaacaaacaaacaaaaaaaaa

SEQ ID NO: 452712 - DNA, 3630 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcgtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452713 - DNA, 1514 bp, Homo sapiens
  misc_feature (2)..(2): n is a, c, g, or t
tnaggctaggtacgaggctgggtgttgaatcggccgaggctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452714 - DNA, 1508 bp, Homo sapiens
aatagacgagacgagtgtgtaatcaggacgaggctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452715 - DNA, 980 bp, Homo sapiens
cggcacgaggtgatgttggagcggccgcataggttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452716 - DNA, 995 bp, Homo sapiens
gtgtcgctgttgcctccgtgtcgctgttccctccgtgtcgctgttcctcgcccgtgtcgctgttccccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452717 - DNA, 3354 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaacccttgcaagaaggatcagccctttctgtgccagcctcgatcgccttgtgctttggtctctttttctcccccccgcctggatcctgcctcgcgcgggccgtcctgttgc

SEQ ID NO: 452718 - DNA, 580 bp, Homo sapiens
ccaagacaactgcaatgccactcatcatgtcagccaccagcgccaacttccagctctggggaggaaagatctcccactggcaaaggtgctctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452719 - DNA, 1782 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtgagtgggggcagctgtgccagctcggggacgtgtccgtacccagtggtatgtcactcctcatgattttgatcatcgcagtctgtttgggttgtcttgtttaccatctcagctggctttcctggtgtctcacgctaagatttgtttgagaggtaacaatcattctgc

SEQ ID NO: 452720 - DNA, 413 bp, Homo sapiens
tatgaactctaactttggtgctgaatatggtagctgacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggttagtgatttctgccccctggcttatcag

SEQ ID NO: 452721 - DNA, 4162 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaactcgtcgggggttccgttacccaattccccctataggggggcgcattacacttccttgggcgtcgttttcactctcttgactgggaaacctctggcttacccaccttacg

SEQ ID NO: 452722 - DNA, 3079 bp, Homo sapiens
tctggtgcggaaccgtgtagccattgtcctgtccctagaccacgaaccccaattctctttacctcccagtgttctttatttttttgagacaggaactcgttgtgttgtccaggccggtgtcgaactcctgggctcaagcagtcctaccaccacagcgtcctgagtagctaggactgcacgggcacgccaccacgcctggctccagttatcttttagacagaacacttgtttgccatcccgtcctcttttcaccctgataatactgaagatgagactcagctctcgatgtctggtcacgctgggaacatgttttgtcttcccttaggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452723 - DNA, 3686 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452724 - DNA, 4444 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaaaaaaaaaaaaaaaaaaaaaaaaaaaaaaaaaaaaaaaaaaaaaaaaaaaaaaaaaaaaaaaaaaaaaaaaaagagagagggagagagaagaaaaaaaaaaaaaaaaaaaaaaaaaagtgggtggggccgccgcagcgccggccccaaagaagaagcgtcactacaacaacatcgtgtggggggggggcggagcgcaacacgagaagtagagcaacacgggaaaagaggtgtctcgaaagagagcacagcgggggcaaaagaggggggggggtcactccacacaaaaaaaagcgcgcggggggaacaacagagagagttgtgaagaaaaactagcaggagagatggagggggaaatgcggagggttttcaagagagaggatccagagcagcgcaaaaaaaaaacccgcgggggggac

SEQ ID NO: 452725 - DNA, 3984 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcataaaaacaacatcaaaaacaaacaaacaaaaaaaaa

SEQ ID NO: 452726 - DNA, 1599 bp, Homo sapiens
  misc_feature (2)..(2): n is a, c, g, or t
tnaggctaggtacgaggctgggtgttgaatcggccgaggagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452727 - DNA, 1517 bp, Homo sapiens
ccgaaaaaactaggctaggtgggccggtggtaatggccgaggctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaacatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452728 - DNA, 3580 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacgctggtcctggactcccagaagcgagtcttctcctggggctttggtggctatggccggctgggccacgcagagcagaaggatgagatggtcccccgcctggtgaagctgtttgacttccctgggcgtggggcttcccagatctatgctggttacacctgctcctttgctgtcagtgaagtgggtggtctgtttttctggggggccaccaacacctcccgtgaatctaccatgtacccaaaagcagtgcaggacctctgcggctggagaatccggagcctggcttgtgggaagagcagcatcattgtggccgccgatgagagcaccatcagctggggtccgtcaccgacctttggggaactgggctacggggaccacaagcccaagtcttccactgcagcccaggaggtaaagactctggatggcattttctcagagcaggtcgccatgggctactcacactccttggtgatagcaagagatgaaagtgagactgagaaagagaagatcaagaaactgccagaatacaacccccgaaccctctgatgctcccggagactcctccgactccacacctctcgcggcagctgtcatttccatgtgcactgggacgggaagtcaaacgaggaatttaaaaaagcaaaagttgaccgaaggtgcatttttgtttagactccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatccgggtcactccttctccgctttttcttgcagatgggcctaggccggtgtcggttctgtttctccccttggctgcctgtacgcccacagccttctggctgcgacattatagaatcggccgtgtcccccctggtgggggattggggatctgtgtttagccatttatatctactttagctgttaaagaggtccaaatgaaaatcaggtgattgtggaaccatggggacttgggggtggggcagaggtgggaacatttgtatcagttgagtcagcttggtggctccctgtggagccagggctgagccttgtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagtttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtgcctggtttagtgctgtaattgtcttattattttttttatatatatatttcttggagtaaacattttaaataaacaacaacattgtctactgtcaaaaaaaaaacacaaaaagacaagaaaagaagttcagggggatttgtagattgttgggttgag

SEQ ID NO: 452729 - DNA, 1469 bp, Homo sapiens
ggaagctcgtatttacattttaagtgtatctggtgagtgggctggagccctcgtctgggccggaaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagcgctgcggcgcggccggcgacagcaggcaaggcgggcggcgcggccgtggtcatcaccgaacccgagcacaccaaggagcgcgtcaaacttgaagggtcaaagtgcaaagggcagcttttgatttttggggcaaccaactgggacttgattggtcgaaaagaagtgcctaaacagcaagctgcttaccgcaatctcggtcagaatttgtgggggccccacagatatgggtgcctggcgggggtccgggtgcggacagtggtctcgggctcgtgtgctgcacacagcctcctcatcaccacggaagggaagctgtggagctggggtcgaaatgagaaggggcagctgggacatggtgacaccaagagagtagaagcccctagactcatcgagggtcttagccacgaagtgattgtgtctgcagcatgtgggcggaaccacaccttggccttgacggaaacgggctccgtgtttgcgtttggggaaaacaagatggggcagctgggccttggcaaccagacagacgctgttcccagccccgcgcagataatgtacaacggccagccaattaccaaaatggcctgtggggctgaattcagtatgataatggactgcaaaggaaacctctattcctttgggtgccctgaatatggtcagctgggacacaactcagatgggaagttcatcgcccgggcacagcggatagagtacgactgtgaactagttccccggcgagtggccatcttcattgagaagacgaaagatggacagattctgcctgtaccaaacgtggttgtacgagacgtggcctgtggcgctaaccacacggtgaggctcggcttttctcacttcctgagagtcgcaccaggatggaaggggtgtttatgctcaagtttcctgacgcttggctttggctaggaactgatcccaggtagacatctgcttgcttcttcaagagggctttgcaccttggccaaagggtccttggtcccagggcagggttccctgtcactgcctcctatgttaacttctcccgtgatttaaatagacacatcttaaacacgtagatgttttgccgccctcacctgggcgacagaacgagaccccatctcaaaaaaaaa

SEQ ID NO: 452730 - DNA, 306 bp, Homo sapiens
gtgatctgcccgcctcggcctcccaaagtgctgggattacaggcatgagccaccgtacccggccaatctgtgttcttaaaatgcttcttctattaccctgaaaacacacagagactcactcacccacacctcgtattaagaccacttataaaagcaacttttttccctagtcttatttagccttgagaatacaagcaatttttaatctcagtttcactcacctaccgcatccgttgcatgacccttgggaaggaactaaaatacattcactccagggcccaaagcatccaagttgtcttttttttt

SEQ ID NO: 452731 - DNA, 2501 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452732 - DNA, 2447 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452733 - DNA, 2599 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggtacagtggctggggtcagggtcgtgtctaggggacggccgagggcctcggagggcgagtattgaggaacggggtcctctaagaaggccggactggaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452734 - DNA, 2330 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452735 - DNA, 2448 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaaccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452736 - DNA, 1618 bp, Homo sapiens
agaatatctatgatttacagagtaagttattctagacctcaagagtgaaatgtaggggaggagacatttgtgtgttaaactaatggaaatgctcatttaatagatattcactgaaagtattagttttggtttattgctagaaaagttgaggttttatggagatttttgtaaaaaatggtttatttcctaaataaatatctctttttcttttttctcccagaaaatgttaatctatgatccagccaaacgaatttctggcaaaatggcactgaatcatccatattttaatgatttggacaatcagattaagaagatgtagctttctgacagtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452737 - DNA, 1255 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtaaaagcttaactaattttattaatatttatgcactgtggatataaagggactatatatagaagtccctgcattttgtgggaatatgcttggaaaaagtgttagaataagaaaaagtatttcatttttctccctcatggttagtttatacaggttagagatacccatgttattaccagatagtgtttctagtaagtaaaaattagtgcctgagataacatagaactggtaggtattgttggaagctagggtagtctggtctttctttggctgtcagatacatgtaaaacaaagtaatgaaagcctagggcagagtggtggttgtaggtgttttattccagttttgaacatgttttggtcaatttattgtagacatttattatatttcaggtaaattataaaattgtatagttttaagtactgaagtatataaaagtgtcttattcttgcaccagttctaccaaaccactctgcagaggtagcgctgttagttttatttgtaatcttacacttgtatgtatgttcactttgtatgtatataaagatttttttttttacacaaggtggacttatttgcatatgtatatatacatattttcccttttttgtgtaaaacattatcaagacgtagatctacctatgtctatttacatttttgatataattaaaccacttccatattg

SEQ ID NO: 452738 - DNA, 307 bp, Homo sapiens
gaaaaaaatcagactagaaagtgaagaggaaggggttcctagtactgcaattcgggaaatttctctattaaaggaacttcgtcatccaaatatagtcaggtatgttgtaatatctgaatgtaagccattttctgcatgctatttcaaatataaatttcaacttggaaatctttacatttgctcaatttcttggtctagccttactgagtggactagaaccctatttttggtagttgagaatgccgcacatatgtaaaagagaacaggctgttaaagcaggaacagagttggaggagctgggtgatgt

SEQ ID NO: 452739 - DNA, 542 bp, Homo sapiens
ctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataatgctgctcattgtgattcttacctataagcagcctaatttgaattatttgctgcaatcaagagaagtg

SEQ ID NO: 452740 - DNA, 2447 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452741 - DNA, 2390 bp, Homo sapiens
cctctttctttcgcgctctagccacccgggaaggcctgcccagcgtagctgggctctgattggctgctttgaaagtctacgggctacccgattggtgaatccggggccctttagcgcggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452742 - DNA, 2097 bp, Homo sapiens
atggatctgaagaaatacttggaaagaaactcaaagatgagatataacctggaatcctgcataagcacatcctgaagactgactatatttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaataaaaaaaaaaaaaaaaaaaaaaaaaaaaaaaaaaaaaaaaaaaaacaatacaaaagagaaaaaaaaaataaaagcagacaacgcaggaaatcactagatctacacaacgggctggggaagctaaatagtagagtcgcgatctacaacggactctgttgtatgcgcacgcaacgcttctaacaatggcagtgacttgatcaataagcggcaagccttgaaacaacccgttcgagcacagggaaccccttgactatcagaacggggtgaacgatacagtgcgcgcaccaaagcgcacgtcacgcgcgaattataaaaggcccaataggataaaatttgttgaaggtgtcaccatggaataagcctgtgacccaccacagtcatattccgacggacagaaatattgcggatgccgaatattgtatatagacaatctatacagtgtagaaaatatcgcaacgacatcctagcaaccaacgaga

SEQ ID NO: 452743 - DNA, 892 bp, Homo sapiens
cctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaaccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcaggtagctattaaaaactgagataataaaggtaacatata

SEQ ID NO: 452744 - DNA, 2050 bp, Homo sapiens
cagatggtgtctaatgaaagcaatgagtctatgaaaattttacctagaatatcatcataaattaaattagcaagtgcgctggatcttggcagcgctgctgaaatgacaacagtaaaataatacctggttctccatctgaatacatcaatgcaggttctcctcgtgacagacttgcatatgtttgttagtttctgcctgtattgtcactgcgcaacggatggcattcattacaagaagagcccatcatcgttgtgtttgcatggtttttttccttgtgtgtagcccatgttgggaacacgatacaggttctcctcttatttcctatgacacgatttcccttgtggaaatttaagactttaagaactagagtatttttatggtgtctgcacctgcagttctgtgtttaaaatgtcataatgtggatcctggagtcaggctactagtcagtgcccctagccagaggctggttcatgagttcatcaactgaggcctctgtggcttcaataaagtctacattttgctcacagatcacaacattcactgtggaaatatgatttcatttctttaggctacaaacctgtatttctttactgaatgctaaggccatgtttatattgggtagaaagatattgagatcccaattttgtacaagattgtgatttcattatctaaaccttaaacttaatcctttaaattttgtagcttttggctgcatctgccccaagtactattccaggcaaattaaagttggaatacctttaataatataaaaataatgatagtaaatcttatacttctgttggcccttagcttgaaaatagcagttaaaaaaatttaaatgttgccttgattatcagtacttaattatgttgtgcactaaaaccttaaatatttattactgtgaataaaaacaaattatctttactgtatagctggtttctttaaatgttgatagaattgtggcattacatctaaatttgtaagtcttttcatatcaaacaagcaaggctttttatgctgctaagtctgtgggtgcagaaagaaacaccccttggaagggcaaagagaagccggctggttgcatcaccccgtgcagtttctcacacacatctctttttctgattctgtgttcagaagaggctgccggcataaaacctaaatgcaaggttgacggagaacagcttgtctggcacaacaatggtgcaggcccacgagccagcatcacagcttggccatgggacgttgagtatgcacaaactagaactcttcccttcccaccttaggaatagaaaatcctcttcctttctaatctgaaaaacgaaaactgaacaaacacaaaaccaaccccttggcagttcccacctcctattgacatatggaatattgtgccttattgtaaaccagtttgaaaaatgttctgtaactaaagtgggttttcggctattatgtatacagcttggtatattactacgaaagataaccaccttgtgttgcaccttaaaaatatcaagaccatgtaatttccataacaaaataggtggcctggctatggtattatagcatacaattaggacactatgcccctgcaaaattttgtaaatcaaattcagaggcaaaaacatattttagaatcatacagtttgcacacgacaagtaggtaataactgtctctaaaaatgttttctccttagtccgcaatgagctaagattcagaatagtgtcaacagcatgctcctatatgaagttgttttttttaaagcacatttgtttatgacaagcctacattctcagtgaatatggcatttagtatttcttttgaaaacaaacttaagcatcatgagccaaagttgcactttgactcccaactacggtagcattatggacatctcacaatgtcaagggtttctgttatgtattagtaaagtatagattattggggcctacataatttaaaagaaatgtaaattaatattaaaagcttgtaaaaatatgtatatctttactatttctcaataaatacctttgcaattgttttcatttccttcaccct

SEQ ID NO: 452745 - DNA, 211 bp, Homo sapiens
tcagtttacctagtgccaaaaagggcttttgctgtttttgcattattaaatgtaatatagtggacataaccattaaacatttgaattagttacatggtggtagcaagaaatggagaactcatgttactaaaaatttttaagaaaaaatgtgtaatctgtataatgattcgaagagtacctgttgaatgtccatttttgataattgtgtgca

SEQ ID NO: 452746 - DNA, 2713 bp, Homo sapiens
tccatcccaccctccgggagaggcagccggcgatccgctctctgcgccctgggaaaaagccccagccatgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatgaggacgaggaagaggaactgctggaggacgacgaggaggagctgctggaggacgacgcccgcgcgctgctcaaggagccccggcgctgtcctgtggccgccactggcgccgtggccgcagcagctgccgctgcagtggccacagagggcggggagctgtcacccaaggaggagctgctgctgcacccggaagacgctgagggcaaggacggcgaggacagcgtgtgcctctctgcgggcagcgactcggaggaggggctgctgaaacgcaaacagaggcgctaccgcaccacgttcaccagctaccagctggaggaactggagcgggccttccagaagacgcactacccggacgtcttcaccagggaggaactggccatgaggctggacttgaccgaggcccgagtccaggtctggttccagaaccgtcgggccaagtggcgcaagcgggagaaggcaggcgcgcagacccacccccctgggctgcccttcccggggccgctctccgccacccacccgctcagcccctacctggacgccagccccttccctccgcaccacccggcgctcgactccgcttggactgccgctgccgccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaa

SEQ ID NO: 452747 - DNA, 1621 bp, Homo sapiens
ccaccttcccttcttttgctctcctctccttttctccttccgcattctctcctgggagatagtgtcattgcagcccctggccttggaataaaccgtccgtttaagcgaaaccaccgaatccacgccactgggccgtggggcttgaggtctccacgccggcctgtggaccccggcccggcccggcccctcggggaatatctggactcggtcttttccccccagtcggttccctgccccaggaaagccctctctgcggggtccagcttccgcccgcgccctctgcccacttccccgccgcggcccatccgggtcccgtgggtaccgcgcccctcagctgccccggcgacaagcggcgggagacgctgcccgaggcgccgcgcacagctcccgaggccatgaccgcgctgtttgctctccctgcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaa

SEQ ID NO: 452748 - DNA, 1649 bp, Homo sapiens
tccatcccaccctccgggagaggcagccggcgatccgctctctgcgccctgggaaaaagccccagccatgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggctcccctaagagcagcagcgccccgttcgaggccgagctgcaccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaa

SEQ ID NO: 452749 - DNA, 848 bp, Homo sapiens
gcttacacaagaagggaggagagaaaagccatggccggtgagtcttttactgtcccaaaaacaggcccctgggaggaaaaagttgtggaaggcgcttgctcttctggaagctatcatcatcggaaaggggctccagcatgccaaatttgcatcacatacatttgtgaagaagacagtcacctggcagggacgctgggactctcagcaggtccaacacatctggaaatcaccttactacacaagattctcaaatagtacttccttcctaggtaatgctgtttttaaagaaagagcattctttgaaccgtggcttcccgtgacattaatgttgtaggatgaaccacagttaaaggggctatgaagaattcccatagagtgatcatacaattttctttttgtaatctattctgcttttgtagcaactgtcaaaacagcttcactatctatgtttacattaaaatttggaatcagtatctcaaatcctgattacccaaataagtaccaaacttcatcatttaagcctactgaaatattccctcacgtctcctagagacacctttatctaaacaatatcagagctgaacatgccattcttccccaccctgcttctcttccagttttgtgtaactcggttattgatgtcaccatcaccagttgttcaaaccaggaacttgaaacacatcttggcccctttcctctcacgcatctccaatattcaagccaccgccaagttttatgcattcttctctcaaatttggaactgtctcgctatttcttcttctatttcattaaaaacccctattcatcaagggccctcttaaaataaaagaaacttatatttaaaagca

SEQ ID NO: 452750 - DNA, 202 bp, Homo sapiens
  misc_feature (49)..(49): n is a, c, g, or t
atccatctcaatctcacatccaccccaaatcgcgtcacccacccgcccnctcgagaagaaactaagttccagtacttggatgtcaacttgctgacgacaaggcacttccttacaatgagcctggaattctaagcagcagtttcacaatctgtaattgcacgtttctgccctttacaataaagaaatacacagtttcctttca

SEQ ID NO: 452751 - DNA, 1132 bp, Homo sapiens
gcttacacaagaagggaggagagaaaagccatggccggtgagtcttttactgtcccaaaaacaggcccctgggaggaaaaagttgtggaaggcgcttgctcttctggaagctatcatcatcggaaaggggctccagcatgccaaatttgcatcacatacatttgtgaagaagacagtcacctggcagggacgctgggactctcagcaggtccaacacatctggaaatcaccttactacacaagattctcaaatagtacttccttcctaggttcaactttcatttgagcagccagatgataaagcacagatgcccagcactgaaagagttacttcgacaagacgtttctatctcttcccagtacattaaaataaggaagctgtatgaatgtctgagggccggtatgtgtgtgtggtcaggagtgtgggaaggttgagtaaagtgtactgaaagtccattttagtcaaggactcgaagtctaccgattgagaatttttaatccaaaaatttaaattttgaaatgctctaaaatccaaaactgtgtgagcgcccacatgatattcaaaggaaatgcttattgaagcatttcaaattttaggtttttggaataaggatgctaaaccagtaagtataatgtagatattccaatatacaaaaatatctgaatttcaaaatacttcaggtagcatgaattttggataagggataatcaagccgtggcataatatacagaaaatactgaagtaatgcctttcttctggtctctgcagagcatgctgctcttcttccaaagtttttctttttttcttttagaccctttctgagggtcagctgatattgacctagaagtggccataagtctatgaaggctgactcttagatgtttctccccttcacctcagcagggtaacattttaaaatagcatgtggcctttccttttaaggttgcatatgttcccattggtggtataactttataacttacatttcttttagcaaaattctcttttatgcttgttttttttccccataggaaacctagagtttcttcattctgtaatggtttttggaattatatctgtttaataatagacttctgaacattttaataaatctgatataaaagtaaaaac

SEQ ID NO: 452752 - DNA, 1959 bp, Homo sapiens
gcttacacaagaagggaggagagaaaagccatggccggtgagtcttttactgtcccaaaaacaggcccctgggaggaaaaagttgtggaaggcgcttgctcttctggaagctatcatcatcggaaaggggctccagcatgccaaatttgcatcacatacatttgtgaagaagacagtcacctggcagggacgctgggactctcagcaggtccaacacatctggaaatcaccttactacacaagattctcaaatagtacttccttcctaggaaatgactacagagttggaggtattttctctgcaccaagagcacaaggcctctggtctcatggtattcgggaaggcatttgtgggaagaaatactctgagcaagtcccagatgtattacaactcaatgaaatctttaaaacgttgaatagcaagaactgcccaagtttgaaggacaaacccaaggtgataatcatccaggcctgccatgttggtgaggctaatgtctttgagaacaccagacattcaaatactgtcctcatctgtattcatcatgaattttcagtttatgtctgttttttagtgtcaaagaacatacactgtcagcactcaagatgtggcttctgtgaattgtatgactggttggtagatatttgttttatattcaagtctgagactttgatgtttggtggtttttaaaattagtttgagagttagaagaaataagaattgttgaaagaatgttacttgaatgtatgtgtgtatgtgcatgtgaattaatgatagagcaaatatattgataaatatgattgaacagacgctaagaggagaacgttgtcctctcagccattggtagtagtaacaaaccaaattttgtctttccagagaaccatggtgtggtgttggtaaaagattcagtaccggcctctgaaaatatatctttaccaactccgggagattttgaggatgatgctattaatcaagtacacatagagaaggattttattgctttctgctcttccacattaggttcaactttcatttgagcagccagatgataaagcacagatgcccagcactgaaagagttacttcgacaagacgtttctatctcttcccagtacattaaaataaggaagctgtatgaatgtctgagggccgcagtcagtcccctcttctgcaggtctgctgcaattcgctgggggtccactacagatactgttcacctgggtatcatcgatggaggctgcagaacagcaaagattgctgcctgctcctttctatggaagcttcgtcccagagaggcacttacctgatgcctgttggaactctcctgcataaggaagaaactaagttccagtacttggatgtcaacttgctgacgacaaggcacttccttacaatgagcctggaattctaagcagcagtttcacaatctgtaattgcacgtttctgccctttacaataaagaaatacacagtttcctttcaaaaaaaaaaaataaaaatataacaaaaattaaatataaaaaaaaaattatcaaacaagtaagttctgtatctaattcaatgccacccccccgagaaccaaatatggggccctttcggccctaacggggggggcttttgggcgcatttctttttaggggggggaaattatgggaccctggatcatggaaccctcggcgcaggagtgaacggtgcggggagggggtctttcccctactcaaggggggggtttgcgggaaaccacaaaattgagggagacccccgggaaaaaaatttgggccaaagggcccaacaggcgtccgaacctcgaaaacgggcccgtgtgggggcgtgttttaaaagcgtctccccccctaaagaacatacaaaaattcccccccaatatacaggggtgggcacaccccaccggctataataaaaccaaagcgtttccacctgaaaactccctacaggcccccttcgt

SEQ ID NO: 452753 - DNA, 548 bp, Homo sapiens
gcttacacaagaagggaggagagaaaagccatggccggtgagtcttttactgtcccaaaaacaggcccctgggaggaaaaagttgtggaaggcgcttgctcttctggaagctatcatcatcggaaaggggctccagcatgccaaatttgcatcacatacatttgtgaagaagacagtcacctggcagggacgctgggactctcagcaggtccaacacatctggaaatcaccttactacacaagattctcaaatagtacttccttcctaggttcaactttcatttgagcagccagatgataaagcacagatgcccagcactgaaagagttacttcgacaagacgtttctatctcttcccagtacattaaaataaggaagctgtatgaatgtctgagggccggaagaaactaagttccagtacttggatgtcaacttgctgacgacaaggcacttccttacaatgagcctggaattctaagcagcagtttcacaatctgtaattgcacgtttctgccctttacaataaagaaatacacagtttcctttca

SEQ ID NO: 452754 - DNA, 598 bp, Homo sapiens
gcttacacaagaagggaggagagaaaagccatggccggtgagtcttttactgtcccaaaaacaggcccctgggaggaaaaagttgtggaaggcgcttgctcttctggaagctatcatcatcggaaaggggctccagcatgccaaatttgcatcacatacatttgtgaagaagacagtcacctggcagggacgctgggactctcagcaggtccaacacatctggaaatcaccttactacacaagattctcaaatagtacttccttcctagcagtcagtcccctcttctgcaggtctgctgcaattcgctgggggtccactacagatactgttcacctgggtatcatcgatggaggctgcagaacagcaaagattgctgcctgctcctttctatggaagcttcgtcccagagaggcacttacctgatgcctgttggaactctcctgcataaggaagaaactaagttccagtacttggatgtcaacttgctgacgacaaggcacttccttacaatgagcctggaattctaagcagcagtttcacaatctgtaattgcacgtttctgccctttacaataaagaaatacacagtttcctttca

SEQ ID NO: 452755 - DNA, 1297 bp, Homo sapiens
gcttacacaagaagggaggagagaaaagccatggccggtgagtcttttactgtcccaaaaacaggcccctgggaggaaaaagttgtggaaggcgcttgctcttctggaagctatcatcatcggaaaggggctccagcatgccaaatttgcatcacatacatttgtgaagaagacagtcacctggcagggacgctgggactctcagcaggtccaacacatctggaaatcaccttactacacaagattctcaaatagtacttccttcctaggaaatgactacagagttggaggtattttctctgcaccaagagcacaaggcctctggtctcatggtattcgggaaggcatttgtgggaagaaatactctgagcaagtcccagatgtattacaactcaatgaaatctttaaaacgttgaatagcaagaactgcccaagtttgaaggacaaacccaaggtgataatcatccaggcctgccatgttggtgaggctaatgtctttgagaacaccagacattcaaatactgtcctcatctgtattcatcatgaattttcagtttatgtctgttttttagtgtcaaagaacatacactgtcagcactcaagatgtggcttctgtgaattgtatgactggttggtagatatttgttttatattcaagtctgagactttgatgtttggtggtttttaaaattagtttgagagttagaagaaataagaattgttgaaagaatgttacttgaatgtatgtgtgtatgtgcatgtgaattaatgatagagcaaatatattgataaatatgattgaacagacgctaagaggagaacgttgtcctctcagccattggtagtagtaacaaaccaaattttgtctttccagagaaccatggtgtggtgttggtaaaagattcagtaccggcctctgaaaatatatctttaccaactccgggagattttgaggatgatgctattaatcaagtacacatagagaaggattttattgctttctgctcttccacattaggttcaactttcatttgagcagccagatgataaagcacagatgcccagcactgaaagagttacttcgacaagacgtttctatctcttcccagtacattaaaataaggaagctgtatgaatgtctgagggccggaagaaactaagttccagtacttggatgtcaacttgctgacgacaaggcacttccttacaatgagcctggaattctaagcagcagtttcacaatctgtaattgcacgtttctgccctttacaataaagaaatacacagtttcctttca

SEQ ID NO: 452756 - DNA, 873 bp, Homo sapiens
gcttacacaagaagggaggagagaaaagccatggccggtgagtcttttactgtcccaaaaacaggcccctgggaggaaaaagttgtggaaggcgcttgctcttctggaagctatcatcatcggaaaggggctccagcatgccaaatttgcatcacatacatttgtgaagaagacagtcacctggcagggacgctgggactctcagcaggtccaacacatctggaaatcaccttactacacaagattctcaaatagtacttccttcctagagaaccatggtgtggtgttggtaaaagattcagtaccggcctctgaaaatatatctttaccaactccgggagattttgaggatgatgctattaatcaagtacacatagagaaggattttattgctttctgctcttccacattaggttcaactttcatttgagcagccagatgataaagcacagatgcccagcactgaaagagttacttcgacaagacgtttctatctcttcccagtacattaaaataaggaagctgtatgaatgtctgagggccgcagtcagtcccctcttctgcaggtctgctgcaattcgctgggggtccactacagatactgttcacctgggtatcatcgatggaggctgcagaacagcaaagattgctgcctgctcctttctatggaagcttcgtcccagagaggcacttacctgatgcctgttggaactctcctgcataaggaagaaactaagttccagtacttggatgtcaacttgctgacgacaaggcacttccttacaatgagcctggaattctaagcagcagtttcacaatctgtaattgcacgtttctgccctttacaataaagaaatacacagtttcctttca

SEQ ID NO: 452757 - DNA, 556 bp, Homo sapiens
ttcttactaaaatataagaaaatggaaagataatttgacctctgacttccaggagaatgttcaggccacatctaaaatttaccaaagaatggggaaaaaacttttttcaagttggaaggtaccagagtgattagctggtctaacctactcattttacagattagaaaactgagatatggcctgggcgacagagtgagactccatcccaaaaaaaaagatttatgcaaattatatctgctctgtagaaataactgtttaacaccatgcaagaaggcggttcaacggtgaaaatttggaccttatatcactgcagaggttagaaatacataattttggaaatataagtgcatatttttgtagtatttttttaaacccaatcctttcataaacttgagaactgaaattacttcagactgcacgtgtattatattaagaacatttttccagatatagagaaacataatatatagaactagtcactaaaaggagacagacactgaaatctagttttcattggtttgacagccttttttttttaaatgtagcttaaatttca

SEQ ID NO: 452758 - DNA, 1738 bp, Homo sapiens
tgcaacactcgggtagttactggggaaccgagcagacgctcagacacttccgagccttgagaaatccgttctcccgccaggcttcggtgtgagttaaagtcgggcagccggaaagcgacaggctcagacccgcagccggtggcctcgtagcccgcgcccggccatatctcagttttctaatctgtaaaatgagtaggttagaccagctaatcactctggtaccttccaacttgaaaaaagttttttccccattctttggtaaattttagatgtggcctgaacattctcctggaagtcagaggtcaaattatctttccattttcttttattttagtaagaatttcgcaaatgacaagtgataacaaaggcagcaggatttttcatttctctgtaaataatgtataaaatatgtgaacagaactatatctttcatctaaggccagttcaatttattaaaaataaaactaatgccttttaaaattgatcagacctttgatacttgaactaaattttgcattagagactttttaaaaattgttcgcttttgctgaataaattgcaaatagagaagcttcattgacagtcagtccctctctgcttaatgcagttatgggtcctttcgtttatggcaaatgacttacctgacaagagttaattttgcctccattgtatcaagtttgaatattttccaagaaatctgatttatttggcagactctgagagagagaacagattaagtgccgttttaaaactctgtattttcatttataataataaaatatttgccaaaatacagctgttttgtaaaattatctgcaccctcatccaagctttatatttaatagccttaatcacattttatgaagaatgttaaagaaaattttttttttactacatcgaaatgagataattaatttcttttttttttttgggaaatggagtctccctctgtcacccaggctggagtgcagtagcaagatcttggctcactacaacctctgcctcctggttcaagcaattttcctgcctcagcctcccaagtagacgggattacaggtgcgtgccaccacacctggctaatttttgtatttttagtagagacggggtttcaccttgttggtcaggctggtcttgagctcctgacctcatgatctgcccgcctcagactccccaagtgctgggattgcaggcatgagccaccgcgcctggcaaaataagataatttctcaaaataatttggtttcatataactggagtagtaattaatattttaacttcatcaactagatgtatctcctcagtagcatagtaactggtacatccagaaatctgaaatccgagttacttgatacaaattctactttatctaaccattagttattaaggaggtaaaatcttgttctaatttgctattaaaatcttattggttaaatagaaataagaaaaagtataattaagtttcttcatcctcaatgtcaactttatattgtaattaaatgtgtagcaaccaagctgacaatagtgattaagaaattaaagtacagaaatattttatttggggactcaaaatgaacaaaagatagataagattaaaatttcacttaaaaagctgccatctcttcctctcttgccctcccaccaccaataactttaaggggaagagaagctggttttttccctaaacatgtctttaaaataatgatacactgtatttattaattcttgatgcaaaaaaaaa

SEQ ID NO: 452759 - DNA, 1663 bp, Homo sapiens
taagaaattatgtattaatacatatggctcatcgttgaatacagcattcctaacattatcccacattcccccactcccgcgcccggccatatctcagttttctaatctgtaaaatgagtaggttagaccagctaatcactctggtaccttccaacttgaaaaaagttttttccccattctttggtaaattttagatgtggcctgaacattctcctggaagtcagaggtcaaattatctttccattttcttttattttagtaagaatttcgcaaatgacaagtgataacaaaggcagcaggatttttcatttctctgtaaataatgtataaaatatgtgaacagaactatatctttcatctaaggccagttcaatttattaaaaataaaactaatgccttttaaaattgatcagacctttgatacttgaactaaattttgcattagagactttttaaaaattgttcgcttttgctgaataaattgcaaatagagaagcttcattgacagtcagtccctctctgcttaatgcagttatgggtcctttcgtttatggcaaatgacttacctgacaagagttaattttgcctccattgtatcaagtttgaatattttccaagaaatctgatttatttggcagactctgagagagagaacagattaagtgccgttttaaaactctgtattttcatttataataataaaatatttgccaaaatacagctgttttgtaaaattatctgcaccctcatccaagctttatatttaatagccttaatcacattttatgaagaatgttaaagaaaattttttttttactacatcgaaatgagataattaatttcttttttttttttgggaaatggagtctccctctgtcacccaggctggagtgcagtagcaagatcttggctcactacaacctctgcctcctggttcaagcaattttcctgcctcagcctcccaagtagacgggattacaggtgcgtgccaccacacctggctaatttttgtatttttagtagagacggggtttcaccttgttggtcaggctggtcttgagctcctgacctcatgatctgcccgcctcagactccccaagtgctgggattgcaggcatgagccaccgcgcctggcaaaataagataatttctcaaaataatttggtttcatataactggagtagtaattaatattttaacttcatcaactagatgtatctcctcagtagcatagtaactggtacatccagaaatctgaaatccgagttacttgatacaaattctactttatctaaccattagttattaaggaggtaaaatcttgttctaatttgctattaaaatcttattggttaaatagaaataagaaaaagtataattaagtttcttcatcctcaatgtcaactttatattgtaattaaatgtgtagcaaccaagctgacaatagtgattaagaaattaaagtacagaaatattttatttggggactcaaaatgaacaaaagatagataagattaaaatttcacttaaaaagctgccatctcttcctctcttgccctcccaccaccaataactttaaggggaagagaagctggttttttccctaaacatgtctttaaaataatgatacactgtatttattaattcttgatgcaaaaaaaaa

SEQ ID NO: 452760 - DNA, 1641 bp, Homo sapiens
cggacgcgtgggtcgacccacgcgtccgccacgcgtccgactagttccttagatccgcgcccggccatatctcagttttctaatctgtaaaatgagtaggttagaccagctaatcactctggtaccttccaacttgaaaaaagttttttccccattctttggtaaattttagatgtggcctgaacattctcctggaagtcagaggtcaaattatctttccattttcttttattttagtaagaatttcgcaaatgacaagtgataacaaaggcagcaggatttttcatttctctgtaaataatgtataaaatatgtgaacagaactatatctttcatctaaggccagttcaatttattaaaaataaaactaatgccttttaaaattgatcagacctttgatacttgaactaaattttgcattagagactttttaaaaattgttcgcttttgctgaataaattgcaaatagagaagcttcattgacagtcagtccctctctgcttaatgcagttatgggtcctttcgtttatggcaaatgacttacctgacaagagttaattttgcctccattgtatcaagtttgaatattttccaagaaatctgatttatttggcagactctgagagagagaacagattaagtgccgttttaaaactctgtattttcatttataataataaaatatttgccaaaatacagctgttttgtaaaattatctgcaccctcatccaagctttatatttaatagccttaatcacattttatgaagaatgttaaagaaaattttttttttactacatcgaaatgagataattaatttcttttttttttttgggaaatggagtctccctctgtcacccaggctggagtgcagtagcaagatcttggctcactacaacctctgcctcctggttcaagcaattttcctgcctcagcctcccaagtagacgggattacaggtgcgtgccaccacacctggctaatttttgtatttttagtagagacggggtttcaccttgttggtcaggctggtcttgagctcctgacctcatgatctgcccgcctcagactccccaagtgctgggattgcaggcatgagccaccgcgcctggcaaaataagataatttctcaaaataatttggtttcatataactggagtagtaattaatattttaacttcatcaactagatgtatctcctcagtagcatagtaactggtacatccagaaatctgaaatccgagttacttgatacaaattctactttatctaaccattagttattaaggaggtaaaatcttgttctaatttgctattaaaatcttattggttaaatagaaataagaaaaagtataattaagtttcttcatcctcaatgtcaactttatattgtaattaaatgtgtagcaaccaagctgacaatagtgattaagaaattaaagtacagaaatattttatttggggactcaaaatgaacaaaagatagataagattaaaatttcacttaaaaagctgccatctcttcctctcttgccctcccaccaccaataactttaaggggaagagaagctggttttttccctaaacatgtctttaaaataatgatacactgtatttattaattcttgatgcaaaaaaaaa

SEQ ID NO: 452761 - DNA, 1588 bp, Homo sapiens
tgcaacactcgggtagttactggggaaccgagcagacgctcagacacttccgagccttgagaaatccgttctcccgccaggcttcggtgtgagttaaagtcgggcagccggaaagcgacaggctcagacccgcagccggtggcctcgtagcccgcgcccggccatatctcagttttctaatctgtaaaatgagtaggttagaccagctaatcactctggtaccttccaacttgaaaaaagttttttccccattctttggtaaattttagatgtggcctgaacattctcctggaagtcagaggtcaaattatctttccattttcttttattttagtaagaatttcgcaaatgacaagtgataacaaaggcagcaggatttttcatttctctgtaaataatgtataaaatatgtgaacagaactatatctttcatctaaggccagttcaatttattaaaaataaaactaatgccttttaaaattgatcagacctttgatacttgaactaaattttgcattagagactttttaaaaattgttcgcttttgctgaataaattgcaaatagagaagcttcattgacagtcagtccctctctgcttaatgcagttatgggtcctttcgtttatggcaaatgacttacctgacaagagttaattttgcctccattgtatcaagtttgaatattttccaagaaatctgatttatttggcagactctgagagagagaacagattaagtgccgttttaaaactctgtattttcatttataataataaaatatttgccaaaatacagctgttttgtaaaattatctgcaccctcatccaagctttatatttaatagccttaatcacattttatgaagaatgttaaagaaaattttttttttactacatcgaaatgagataattaatttcttttttttttttgggaaatggagtctccctctgtcacccaggctggagtgcagtagcaagatcttgggctcctgacctcatgatctgcccgcctcagactccccaagtgctgggattgcaggcatgagccaccgcgcctggcaaaataagataatttctcaaaataatttggtttcatataactggagtagtaattaatattttaacttcatcaactagatgtatctcctcagtagcatagtaactggtacatccagaaatctgaaatccgagttacttgatacaaattctactttatctaaccattagttattaaggaggtaaaatcttgttctaatttgctattaaaatcttattggttaaatagaaataagaaaaagtataattaagtttcttcatcctcaatgtcaactttatattgtaattaaatgtgtagcaaccaagctgacaatagtgattaagaaattaaagtacagaaatattttatttggggactcaaaatgaacaaaagatagataagattaaaatttcacttaaaaagctgccatctcttcctctcttgccctcccaccaccaataactttaaggggaagagaagctggttttttccctaaacatgtctttaaaataatgatacactgtatttattaattcttgatgcaaaaaaaaa

SEQ ID NO: 452762 - DNA, 1610 bp, Homo sapiens
taagaaattatgtattaatacatatggctcatcgttgaatacagcattcctaacattatcccacattcccccactcccgcgcccggccatatctcagttttctaatctgtaaaatgagtaggttagaccagctaatcactctggtaccttccaacttgaaaaaagttttttccccattctttggtaaattttagatgtggcctgaacattctcctggaagtcagaggtcaaattatctttccattttcttttattttagtaagaatttcgcaaatgacaagtgataacaaaggcagcaggatttttcatttctctgtaaataatgtataaaatatgtgaacagaactatatctttcatctaaggccagttcaatttattaaaaataaaactaatgccttttaaaattgatcagacctttgatacttgaactaaattttgcattagagactttttatcagtccctctctgcttaatgcagttatgggtcctttcgtttatggcaaatgacttacctgacaagagttaattttgcctccattgtatcaagtttgaatattttccaagaaatctgatttatttggcagactctgagagagagaacagattaagtgccgttttaaaactctgtattttcatttataataataaaatatttgccaaaatacagctgttttgtaaaattatctgcaccctcatccaagctttatatttaatagccttaatcacattttatgaagaatgttaaagaaaattttttttttactacatcgaaatgagataattaatttcttttttttttttgggaaatggagtctccctctgtcacccaggctggagtgcagtagcaagatcttggctcactacaacctctgcctcctggttcaagcaattttcctgcctcagcctcccaagtagacgggattacaggtgcgtgccaccacacctggctaatttttgtatttttagtagagacggggtttcaccttgttggtcaggctggtcttgagctcctgacctcatgatctgcccgcctcagactccccaagtgctgggattgcaggcatgagccaccgcgcctggcaaaataagataatttctcaaaataatttggtttcatataactggagtagtaattaatattttaacttcatcaactagatgtatctcctcagtagcatagtaactggtacatccagaaatctgaaatccgagttacttgatacaaattctactttatctaaccattagttattaaggaggtaaaatcttgttctaatttgctattaaaatcttattggttaaatagaaataagaaaaagtataattaagtttcttcatcctcaatgtcaactttatattgtaattaaatgtgtagcaaccaagctgacaatagtgattaagaaattaaagtacagaaatattttatttggggactcaaaatgaacaaaagatagataagattaaaatttcacttaaaaagctgccatctcttcctctcttgccctcccaccaccaataactttaaggggaagagaagctggttttttccctaaacatgtctttaaaataatgatacactgtatttattaattcttgatgcaaaaaaaaa

SEQ ID NO: 452763 - DNA, 788 bp, Homo sapiens
tgcaacactcgggtagttactggggaaccgagcagacgctcagacacttccgagccttgagaaatccgttctcccgccaggcttcggtgtgagttaaagtcgggcagccggaaagcgacaggctcagacccgcagccggtggcctcgtagcccgcgcccggccatatctcagttttctaatctgtaaaatgagtaggttagaccagctaatcactctggtaccttccaacttgaaaaaagttttttccccattctttggtaaattttagatgtggcctgaacattctcctggaagtcagaggtcaaattatctttccattttcttttattttagtaagaatttcgcaaatgacaagtgataacaaaggcagcaggatttttcatttctctgtaaataatgtataaaatatgtgaacagaactatatctttcatctaaggccagttcaatttattaaaaataaaactaatgccttttaaaattgatcagacctttgatacttgaactaaattttgcattagagactttttaaaaattgttcgcttttgctgaataaattgcaaatagagaagcttcattgacagtcagtccctctctgcttaatgcagttatgggtcctttcgtttatggcaaatgacttacctgacaagagttaattttgcctccattgtatcaagtttgaatattttccaagaaatctgatttatttggcagactctgagagagagaacagattaagtgccgttttaaaactctgtattttcatttataataataaaatatttgcca

SEQ ID NO: 452764 - DNA, 388 bp, Homo sapiens
aaatgtagcttaaatttcagtactaacattcagtttcactttggtatttctgatctttgcaatttggttctgttaatgttaaggtttgattttttaaaaaaattatttttcttaagaaattatgtattaatacatatggctcatcgttgaatacagcattcctaacattatcccacattcccccactcccacccgttatctttttttcttcctgatgcccaccccttttcccataggtaatgattcttaatcttggtggaggatgtacaaagtgcggttcagagaaaagaattggcaacaacagcaagagacttggtgttagtctcagtttaattacaatacaaggaagagttgagtaatttgccgcatctcaagaccttgtatctca

SEQ ID NO: 452765 - DNA, 829 bp, Homo sapiens
catatacacctaaaaaaaaagttgagaaaaatcacgtaattgacttcataaagcttgtgttagcacttgaagctctgtgcgccttacccgctccggctcccccgtcatggccttgctggtaagggtggcctgtccctctgctctatgtggtttaggactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggtaggttctcagttattatcacccaagatggaagccttcttctgtgctttttgagaaatttgaaggttcgttaaaatctgttgttaggatgcggcctttaacaaaatcacaagaagccttcaagatcttcagcagaaagatattggtgtgaaaccggagttcaggtaagggtttgcgccacagcggcttggtgtcctcagaggcaggggtgctgtcttctcccggaagcaggccctctcggtggcagaggtgacacgctggtttgatgtggttagttctgaggagcagcgcagttacttgcaaccaaagataaagggctgccctttataggtgactgtgtgtggccgtccccctcccacactgcaccagcacgccagctggatgggagccgctgggcacggggttttgtgcagctggtccccaagtgggcatgtaatttgcccatgtgggttctgcgtgcaggggacatcccacctgcccacccaagggaacct

SEQ ID NO: 452766 - DNA, 4303 bp, Homo sapiens
acggcggagtaaggggtgggctatagggccagatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452767 - DNA, 4666 bp, Homo sapiens
accgccaacgtccacggagcccgcccgggaccctcgacgtgcgcctctgcggacggggcgcgcagagggagccccgttagcggtcccccgctccctcgtccatcctccccaggcgcactccgagtcacacgtcgtgtctctgcaccgccctggcctccacggtggctccctgcgaagctgagggtgcggtccccatcctccgtgggtgccaactccggggcaagcaggctgcagagccgcgcgctccgccttaggcgctgccaagggcggccgggtagggtttcctaggacccgcccaccccgctcgtcccggccggagctgccaccccctggatcagtggagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452768 - DNA, 4013 bp, Homo sapiens
catatacacctaaaaaaaaagttgagaaaaatcacgtaattgacttcataaagcttgtgttagcacttgaagctctgtgcgccttacccgctccggctcccccgtcatggccttgctggtaagggtggcctgtccctctgctctatgtggtttaggactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggtaggttctcagttattatcacccaagatggaagccttcttctgtgctttttgagaaatttgaaggttcgttaaaatctgttgttaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452769 - DNA, 1873 bp, Homo sapiens
cctgaagcaattccattatttttgaattctgttcagcacagtctacagccgtgcgctgccgcttgttcagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452770 - DNA, 4782 bp, Homo sapiens
acggcggagtaaggggtgggctatagggccagatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttgaaaaaaaaaaaaaaaaacacgaaacatcagatcataatgaatgaaaagaggggggctccttccagaaaaatattccccgggagggggccccaccatctgcgatacaccagattgtctgtcaaaaaggggcgcccccattagtgatctcatcatatagcaccgcgcagcggcccctctaacaaccgcggctgctcgcaaaatgctcttgctactttcttggaacgaccccctgcttgttgtgcacactgcccactctcaaacttgacccccgggcataactcagtcttctgttaccggtctcgtcaaatgtctgatttaattga

SEQ ID NO: 452771 - DNA, 1765 bp, Homo sapiens
attacaggcatgagccactgcacccagcctgtggcattttaggctttagatttttggattggagatactcaacctgttataaataggtactagctgtgtttctttaagcaaattcagtgcttcagtttctaaattttgtaaatctgagaatagaaagattgtgtctgtgctgtaattttaaaataatctttacaactgtttttgaagtttttagatgtttatctttttatctacagggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452772 - DNA, 872 bp, Homo sapiens
ccgggcccggggaattccccgggtggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452773 - DNA, 1363 bp, Homo sapiens
acggcggagtaaggggtgggctatagggccagatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggtaggttctcagttattatcacccaagatggaagccttcttctgtgctttttgagaaatttgaaggttcgttaaaatctgttgttaggatgcggcctttaacaaaatcacaagaagccttcaagatcttcagcagaaagatattggtgtgaaaccggagttcaggtaagggtttgcgccacagcggcttggtgtcctcagaggcaggggtgctgtcttctcccggaagcaggccctctcggtggcagaggtgacacgctggtttgatgtggttagttctgaggagcagcgcagttacttgcaaccaaagataaagggctgccctttataggtgactgtgtgtggccgtccccctcccacactgcaccagcacgccagctggatgggagccgctgggcacggggttttgtgcagctggtccccaagtgggcatgtaatttgcccatgtgggttctgcgtgcaggggacatcccacctgcccacccaagggaacct

SEQ ID NO: 452774 - DNA, 343 bp, Homo sapiens
aaagagagctggctcagctgaacaaatgcacctccccacagcagaagcttgtctgcttgcgaaaagtggtgcagctcattacacagtctccaagccagagaggtttgtgcttggaaaggggactggccaaggggtagatgctacatccagatgaaaaagcaaagagtgatgctgtcttaagggatttttatggggctgggtgcagtggctcacctctgtaaccccagtgctttgggaggccaaggtgggaggatcacttgaggccaggaattggaggttgcagtgagctatgatcacaccagtgcactacagcctgggtgatagagtgagaccccttctcaaa

SEQ ID NO: 452775 - DNA, 4460 bp, Homo sapiens
acggcggagtaaggggtgggctatagggccagatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452776 - DNA, 4198 bp, Homo sapiens
gcgcgaattcatcatcctgcttttcgaattcatcatcctgccgcgcgaattcatgatcctgctgcgcgaattcatcatcctgcttgaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452777 - DNA, 2058 bp, Homo sapiens
ctctatgacgccttggtagccccagcgggcagcaatgtgtaaaggggtgtctcctttctcattgctgcccgctggggctaccaaggcgtcatagagacattgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452778 - DNA, 2139 bp, Homo sapiens
catcgcgcctggccttttattatttttaaatagagacagggccttgctatgttgcccaggctagtcttgaacacctgggctcaagcaatcctcccacctcagtctcccaaagtggtgggattgcacgcgtgagccaccgtgcccagttaattaatgtgtttcaatgagtacttactatatgggggccctcaacagcctcatgataagcatatgatagtagatcttattatggttgagctggttgcatggagtggttgaatccccagcgtggagtccacagagagggcagagcttttacccagtggtaaaagcagagccgggctccccatgcaggcctgcttttaccactgggctttatggcctccaagctccatttgtaattatttctgagctttttctgcccagtcacactaatactgacatttagatcaaaaacaaataataacctattaaaaaagaataaaaacattactgttccttttccctttcaaattgcagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgattgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttga

SEQ ID NO: 452779 - DNA, 4122 bp, Homo sapiens
acggcggagtaaggggtgggctatagggccagatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggagctagactgcgtcttgctcacatcagggttctgccttgctaggtatggcattc

SEQ ID NO: 452780 - DNA, 249 bp, Homo sapiens
ctccatgtcagccggctcaaggcaggaggagaccaagaaggactacagagaggtgaggcttccagaggaagggctggggaggggaggccttggcggccctgggcagtggtgtccagctgaagagccgtggcctgacaagggccgccctctcagcctgcttgcccatgctgaggccgctgctgctctgtggtggccgaggttggtgccttcaagctgggcccagcagcatctcgcggtgctgtatatttt

SEQ ID NO: 452781 - DNA, 959 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaa

SEQ ID NO: 452782 - DNA, 541 bp, Homo sapiens
gccgacctactactactaaattaacagacgctcgactgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaa

SEQ ID NO: 452783 - DNA, 3546 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452784 - DNA, 3739 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452785 - DNA, 3802 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggcagaagaaaagaggattcttctctagagaaagtgaacagttcctgagaagtgatctctgcaggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452786 - DNA, 3488 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatattttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452787 - DNA, 3459 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcaga

SEQ ID NO: 452788 - DNA, 3614 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctga

SEQ ID NO: 452789 - DNA, 3229 bp, Homo sapiens
ctcaacgctttatacttcctcatcttgccaggggcagcgaagaatatttgggaggactatcatgaatgcgtgattatgtcagacaccggtctggaaagctgcaagcaaccctttcaccaccatcccctcaaaaatagtaacaaatggtttctcccaccacccacctgcccgtatcctttcaatctctctaatcctcactaaatcacccaggttcaccatatgcatcgagcaactctccattttatcccacgagctggtatttttccccacctgcccagtcttggcgttaacgcccactgggaagtataaagcgttgagctcaaggctgtatacttccaggttctagcagagaggagtgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452790 - DNA, 5097 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgattaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggtggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgccatgcagaccaaaaagttattagttggtgaatatgtattttctctttggaaggtctttaaggggagcaaaccagttttaatcaatcagattgcttggtaagtttggaatctgcaatcagttggtcttaaaaaaaaaaa

SEQ ID NO: 452791 - DNA, 1954 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcaga

SEQ ID NO: 452792 - DNA, 2669 bp, Homo sapiens
tctagccgtggaaacaagagtgaaactctgtctcaaaaggcgaaacagaaagaaagaaagaaagaaagaaagaaagaaagaaagaaagatagaaagaaagaaagaaagaaaggaaagaaagaaagaatgaatgaatgaaagacaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452793 - DNA, 2467 bp, Homo sapiens
cgcgttatggtaggcggagggttgtacacgtgaccggagttagtaggaagaggtccgattttggatcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452794 - DNA, 3870 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgagcgttggtgttgtgagcggcccatgaaaagccaaattaaaaatcaaggattcagtcaaactaagcaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggtggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgccatgcagaccaaaaagttattagttggtgaatatgtattttctctttggaaggtctttaaggggagcaaaccagttttaatcaatcagattgcttggtaagtttggaatctgcaatcagttggtcttaaaaaaaaaaa

SEQ ID NO: 452795 - DNA, 2388 bp, Homo sapiens
tgcagcttgcttctgctggtcgactctgaggtatccccaacccgggacacctttggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452796 - DNA, 2360 bp, Homo sapiens
  misc_feature (2118)..(2118): n is a, c, g, or t
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagaaacaaccaaaccaaacaacaaaaaaaacaaaaaaaaaaaaaaaaaaaacacaacaaacaaacaaacacaacacaacaacaaacacaagaaacaaaacaggggggggggggcagaaaagaaaaacccccgggagggggaacaaacacaagcagcacatacacagnttggtctagacagaaagggaagcccacaacatagagagggcgcaatataaaacaaacccaggcggcgcgtaacaacaaaacacgcgggaggagaaaagcggctcgatactaccagaggagaaaccacacaactgggggggggacaaagcggaaaaccaccacaagaacaagagcaggaggagaaataaaggggtaaaggagacacgaagacatcgggcaaagatgtcacgaatggcgcaacc

SEQ ID NO: 452797 - DNA, 1306 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagagaaaggaaaagacgaagggaagaggaagaaagagaaaaagaaagggctcgtgacaaaaaaaa

SEQ ID NO: 452798 - DNA, 1254 bp, Homo sapiens
tcggtaccccgagtgggtccctgcattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452799 - DNA, 1608 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggcagaagaaaagaggattcttctctagagaaagtgaacagttcctgagaagtgatctctgcaggtactgacccttggggaatctcttaaaagaaagtcttactgcctgattttcctatgataaagcccattcatgagctgacaaaccctgcctaatccctactaacttccagtcagattttggaagtgtctttttaaaaaattagttgcttgcccaggaccaccagccagacgttcgaagaaagccttcaacacaagagattaacaaaaccaacagagaaagaagaatttagtggaattggagatactggggaaagcagaagagagattcttcaaaatcttaagaaatttagtatcttcagagacatatgagaagacactatattcttcagcaataatacgatgccataaagagggaacttgtggaaaaagtgaaaaacattttctgaaaaacaggtcttagaaattaaaactgaagaaatagaactaaaatcaccagaaagatttgaaaataaaattaaggaaatttactggaatattgggcagtacgacagaaggatttttaaaaaacttagtccaggaactgtactaccagcttaatagttgtggacagaataaaagcagagggaattgcttaagaaaaaaaatttgcagtactaaaggacattcatctttaggttgagcaggtcctacaagtgatcaggacagtgaatgaaaaagatccatacctaggcatacccctgtgaaattttagaacacgggggtggtgggggtgggtgtaggtcacagaattatgaatcagaatggcctaagactggtcagtaacaacgggggaagttgaagacattggagaaacatcctcagggtgctgagtgaaaatgtgtctgccggagggggaaaaagacattttcagatatacagggtctcaactgatttatctcccacgggccttttctcaggaaactccaccaaaacatgtccata

SEQ ID NO: 452800 - DNA, 1181 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgatgtatttggaagaggagataacattagagatgtcagcaaatttttggaagatgacaagtggatggaggagtagcagcaaacgcaacagagcagagcaacctgtaccctaaaagcctgcagaaggggatactaaacagaagcgagtgtttgatcagcagaaccctggacaggctcaggatttggaggcaccaggtaccacagaaggcagggttgagtcatggggctgaaaatgagagagattagtctgtagtctagttcagggtttctcaaccttgacattgttgacattttgagccagttttggagggggcttttcatgcattgtgggatgtttagcaacatctctggcctttacccactagataaccagtagcaccccctgttgtgacaccccaaaatgtcttcagacattgccagatgtcccccaggatgcaaaattgccactagtgtaggtggtcctgtgcatctgttgatcttactctcctccccatagaccccaggagaagagagggttattttctggagaaattggactagagagactagtttatctgaaccacaaaatagaaaaaaataattgactatttcctcaattctctcaaggatggtacataaccaggatcattctggatacataaaagaagtcaattcattatgtacaatctttgccttagagcattaggagcatattaaggcaggaccagtctagatcttgagatttcagacacagcaggggcagtagtaagtt

SEQ ID NO: 452801 - DNA, 803 bp, Homo sapiens
  misc_feature (433)..(433): n is a, c, g, or t
  misc_feature (436)..(438): n is a, c, g, or t
  misc_feature (448)..(448): n is a, c, g, or t
  misc_feature (450)..(450): n is a, c, g, or t
  misc_feature (459)..(460): n is a, c, g, or t
  misc_feature (463)..(464): n is a, c, g, or t
  misc_feature (616)..(618): n is a, c, g, or t
  misc_feature (620)..(620): n is a, c, g, or t
  misc_feature (623)..(625): n is a, c, g, or t
  misc_feature (630)..(632): n is a, c, g, or t
  misc_feature (651)..(651): n is a, c, g, or t
  misc_feature (657)..(657): n is a, c, g, or t
  misc_feature (661)..(661): n is a, c, g, or t
  misc_feature (665)..(665): n is a, c, g, or t
  misc_feature (675)..(675): n is a, c, g, or t
  misc_feature (693)..(693): n is a, c, g, or t
  misc_feature (706)..(706): n is a, c, g, or t
  misc_feature (727)..(729): n is a, c, g, or t
  misc_feature (802)..(802): n is a, c, g, or t
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttgncgnnnaaaaaaattnanaaaaaaaanntannaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctgggnnngnttnnnaacannnaaaaataaaaaaaaaattnagtttntaanaaanaaaaataatntagttgtggaagaaattnaagaattagggtntgaaggaaaactataataatnnnattttattatgaaattattttatgaattaaaagaagagagataacgttgtaatttggagaagttgtagaattna

SEQ ID NO: 452802 - DNA, 223 bp, Homo sapiens
agcaattttttaagtacctttgtttttctttactaggtttgtaaatattatctctgtggtttttgtcctgcggaattgttcacaaatacacgttctgatcttggtaagtgaattttctgtgtaacttttatcaaatttatgatatttaaaatgttgaataggagtggtgaaaggaaaaaaactgattataattctgtgaagttttttcttaaagatttgctaa

SEQ ID NO: 452803 - DNA, 3435 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452804 - DNA, 3422 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagcagaagataagattattggactgactactagtcctctacgggacaacaagacgactcttcctcattgaagctacctgtgcaccggagaagcccataaggcacaaagggaggactttcccacaagcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452805 - DNA, 5151 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggtggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgccatgcagaccaaaaagttattagttggtgaatatgtattttctctttggaaggtctttaaggggagcaaaccagttttaatcaatcagattgcttggtaagtttggaatctgcaatcagttggtcttaaaaaaaaaaa

SEQ ID NO: 452806 - DNA, 3492 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452807 - DNA, 3491 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggaccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452808 - DNA, 2854 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagcagcgtaagtatgcacagatgaagatggaactaagccgagtaagaagacatacaaaagcctcttctgaaggaaaagacagtgtagtcctgcaaaacattttgagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452809 - DNA, 2109 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctga

SEQ ID NO: 452810 - DNA, 2041 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452811 - DNA, 2709 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452812 - DNA, 2424 bp, Homo sapiens
ctaacaattaaccggttcctccattaagcgccagtattaacaactcataagcgatgtggttcaccggtgggcgctaacttcgaagcaacattatcgatatgataggccaatcgccgggtcgatttacagacgggtcgtcttgtcggctcctgtgtgtaggagggatttcggcctgagagcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtcgatgcaacacgtctctcagggatcctcagaat

SEQ ID NO: 452813 - DNA, 2511 bp, Homo sapiens
tgcagcttgcttctgctggtcgactctgaggtatccccaacccgggacacctttggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagcgacacagaacaaggaggggactctgactgactaaccacaaacacgtacgtgtgaactgtcctggtacgtcgacgaacaacgcacgacgtgacacgaccagcaaaccacctgaacttcgacacggacacacgtgactacctacacgacactgactggtcaattggggacccaggttgacacgaacacttacaacttctgaacatggtgaacacatcacgttccaaagttaagactctgagtcttgagtaaggaaccatcaagactcatgaccatgagtgttacagctgtactatggttttcatcatcgtattgaatatacggggactttcttagtgattacctggttctgaccagttggcagcggtaacgtcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttaca

SEQ ID NO: 452814 - DNA, 2262 bp, Homo sapiens
ggcggctctgggcgccgggagtcggcgggcggcgaggagcgcggagccggagctggacgccgccgccgccaccgccacctgcgcggcagtcatcaagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatccc

SEQ ID NO: 452815 - DNA, 4329 bp, Homo sapiens
  misc_feature (1)..(1): n is a, c, g, or t
  misc_feature (230)..(230): n is a, c, g, or t
  misc_feature (710)..(710): n is a, c, g, or t
  misc_feature (866)..(866): n is a, c, g, or t
  misc_feature (877)..(877): n is a, c, g, or t
  misc_feature (1020)..(1020): n is a, c, g, or t
  misc_feature (1161)..(1161): n is a, c, g, or t
  misc_feature (1662)..(1662): n is a, c, g, or t
  misc_feature (1795)..(1795): n is a, c, g, or t
  misc_feature (1804)..(1804): n is a, c, g, or t
  misc_feature (2018)..(2018): n is a, c, g, or t
  misc_feature (2056)..(2056): n is a, c, g, or t
  misc_feature (2114)..(2114): n is a, c, g, or t
  misc_feature (2166)..(2166): n is a, c, g, or t
  misc_feature (2193)..(2193): n is a, c, g, or t
  misc_feature (2206)..(2206): n is a, c, g, or t
  misc_feature (2320)..(2320): n is a, c, g, or t
  misc_feature (2381)..(2381): n is a, c, g, or t
  misc_feature (2390)..(2390): n is a, c, g, or t
  misc_feature (2548)..(2548): n is a, c, g, or t
ntttttgtatttttagtagagacagggtttcaccatgttggccaggctggtctcgaactcctgacctcaggtgatccacccaccttggcctcccaaagtgctgggattaggtgaaacagtttcttgcggacttatcttttcattttccatggagatagacctaggagtggaattgctgggtcatgtgggaaccggttaaccttttgaggaactgccagactattttccanaagagctgcaccattttacatgcctaccagcagtgtgtgaggggaaatgcccttttattgaacatctgccatgtgctaggcactgtgccatacctcctctcccatgatcctcacaccaacctgtgaaatacctgtgattgctcccttttactgaggaggacaccagagctcagagaagtgaagtaactcccccaggatcccacaggaataagaagtaaggcctagattcacacccagctctgtcccttatgttttcctgttgactggttgctaactgactatgtgactgtccagatgctaatgtggaatccacctcctccccaaccctcctgggcactgtcttgcagacagggaagttggacccccactacccaaaagtctgcgggcacagaggcaacgttttggatgtcaagtggaacccttttgatgattttgagatcgcctcctgttctgaagatgccacagtgagtgtcagccccngaggggcttccccttcctgaagagtgggattggggtggttggggtggaatggtacctgttcttggctctggtgcccctgactccatcgcggaggtgaggtcactgtgtggggaggtgttaagttaaggtagaggaggagacattcttggtgctgtnggactagcggnaccacccctcctctctatgggccttagttcccccccatataaaatgggcataatagttccacccagctaataaagcccagtgaaaatgtatattccgatgggaaaacccatccttcggggagctataaaaggctatgaggggnatttttatggtgatcagaaaagatgttccacttaatcccatagtgaggaagcgagctataaaaggctgtgagggccttggatgaatgtggacactaaaaccattccagcagcttcagtctcactcacttttttgagcccgngttctgtaccagggttatcatccctgccccaacaatgttcagtgttacttatttacaattcattttgtacccacttctaaaatatggtggtatggcttaagacaagaaccacagatatgccaggttcagtggctcacacctgtaatctcagcactttgggagactgaggtgggagaatcacttgaggccaggagttggagaccaacctaggcaacatagtgagaccctgtctctattaaaaaattaaaaaacacagatatgatcagatgattaaaataaagataaaagtcattgtcaccatttattgtgagcccactgtattcctaactgtcatcacacttatcatttcacagtctccccagcaaccccacaaggtaggatatttttctgatggagaagctgaggatcagagaggtacagcaatttgcctaatgttacacagcctgtgggaggcagagcaagacttcagactgaggcctgtctgattccacagcccattcnctttccaatgtgctgtgacacatctttaaagagaagcagccacagatggagaaactgaggaaatactagaaatgatggctaagaagggttgcagcagctaagctgctagtttagctaagagctacctggcagncaaggcaanatgggcaacagaatgtattgcaaaaccttcagttagatcaaaagaagcagaccagttcatcaggaaaggaaggcagaaaattcaaagaggatttgtgtcggtttccatatagcagatgctgaggaacgtaaaggacagtgtctgccgaggtgatttcaccaaagggacaatcaggtcctgtgagaattggccctgtccccagggagtatagggnctctggcaggatatcaaatatctgaaactgtccccacntttgtgatacctgccttttcaggactgctttgaaggctcccatcaagatctttataantctcttgctagcctcattgcctgccactgccccttccccgatgccccagggnaggacgtgactgttgggggactgaagnaggaaggggcttncctccccgaagctatgcccacagtgaatttatggggtgttcctccctgccttcagggcctggagggcacggttgctcctctagcagtggggagtcttctctgcttcagtgttgngggtggtaccttcatcttccaaacatacctcttcagagtgtgtcttcctcccggggttctntgcagtganagccctcatcagaccgaagtatctggagcctgtcactactctcgtggggttggcttcctggttttaaatccaagatgaccaggaaataaatatttgctgaattgaaagcaaagtcgtctacctgaaaaacctgtatacctctaagggaaacagtgcanacaatcaactaggggccagagaaccttgcaggaccaataaggaagatcaagtcagcagcatcccaggatcaccttgtactccatttgtatacctctgtgacagggagcttactctctgccatggcagccccctccatcttcagacaacactactctggaaggaagtcccagcacctcttctcaggccctcaccatgaaatacaggcccatgaccccatccagcccagcctcctgaccttcagagtttcctcttgcaggccatccagggtgcacctccaaagcaagaagtttgtccctgccctgctgcagagacctcgccggctccctagtgcctgaggatgcagcctaaacccttcatcctggcatttgaggctctaccctgggtctttgggacaagaagaacactgtactttggggatatcctagcttaggagacaggcctgaaacccagccacctgcccaccacctcaggccagcaggatgacaaagatctctcaagggcagatttggaggcctagactcatccctggtcagcgctggcccctgctcaggctggaggagcttggggaagcccctgtctgtctgaggaccctcagctgcccctccactgcccctcaatgcccatagccactgagtgggaggtggctatggagagagctcccttggtccttctgctggtcactgccagatctgtggcttaggctggtgacggtgccaaggtgccctggctaatgctgccttgggccctgtctcccctgccagattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgagtctgggtattctttctctggggcagccccaacaagttcccacaaactggaatacaatggaaatgtattctgtcacagttctggagaccagaaatcgaaaatcaaggtgttgggagagccagctcctccagatgccctagggaagaatccttccatgcctctcccagcttctggtggctccaggcatccttggctatagctgcgtcactccaggctctgtttctgtcttcacacggccttctctctgtgtacctgtcttccttataggaagaggagagcaactatcattggatttagggcccacctaatccattatgatctcatcttaactaatttcagcagcgaagaccccatttccaaataaggtcacattctgaggttccaggtggacatgagttttggggggaaccctgttcaactcattatagcctgcccggagtggatgggatgcactgcccagaaaatcgttcccccgaccctgctccactgacaatcaagcatgcaggcagtaggccctgtagattgggacccacagtacaggagacctcaattctattccgactcagtctctgacctgcactatagcctgggaaagtgccttgacttctctaggcctcagtttcccaatctgtacacaaatggaattggtggcaccatagctatggcctttcagttctttccttttgacactataggggtttacagagacacctcgggaccctctgtgttggataaaagggaggtggggggccggacatggtggctcacacctgtaatcccaacagtttgagaggctgaggtgggaggatcacttgagcccaaggatttgagaccagccaacatagtgagaccccatctctacaaa

SEQ ID NO: 452816 - DNA, 2275 bp, Homo sapiens
  misc_feature (2058)..(2058): n is a, c, g, or t
  misc_feature (2070)..(2070): n is a, c, g, or t
ggcggctctgggcgccgggagtcggcgggcggcgaggagcgcggagccggagctggacgccgccgccgccaccgccacctgcgcggcagtcatcaagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcaggnatgctgtatccngactgggaagcgaggggcgatgttgagcggggagtgaacctcttacagggacggcgagcgtgatccgagtggagcaagggggcacagcgtcgtcgaaacggcatggaccctctaacaaaaatgggggggcgacacagggaaggaataacggctggattcccgtacgtgtttaccaccctgaggtcgtgaccccgccgcgccgctg

SEQ ID NO: 452817 - DNA, 2065 bp, Homo sapiens
ggcggctctgggcgccgggagtcggcgggcggcgaggagcgcggagccggagctggacgccgccgccgccaccgccacctgcgcggcagtcatcaagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaacccctgggtgacagagcgagactccatctcc

SEQ ID NO: 452818 - DNA, 564 bp, Homo sapiens
gtaagtgagggacactgaagttcatgcctgtaatcccagcacttcgggaggccgaggtgggagaatcagggtcagggcttcagtgcggggtctggggagacagggatgagtcagatgggaggagagacagcatagcaacactctgacttggtgggggctgtacttgacgtgtgcaacagcacaaaggaggaagtcagggaaggcttctcagaggaggcaacattggaggaactgaaagaggaagcagagcccagcaggggagagagggatgtgttctaggtcaaggttaagcagttaccacaagagcagagatggaaagggctgacctagaagagcctctaggaagcagtcctcagttcctttctaagtgtgcttgaggattaaaaacacagctatatttctgtaatctacaagaaacccactttaaacataaagacatggctagattaaaagtaagggactggagaaagatgcaccctgctaaccctactcaaaaggaatctggagcggtttgattaagagcatttgggtcacaggagctgtggggatggagatggggaacct

SEQ ID NO: 452819 - DNA, 2431 bp, Homo sapiens
cacaggggcactgacatctttgctggactcttttaatcctcataaacccaggctgctggcactcgaaatttgagaagggcaatcagtctggcctcttgcctttctggcctgcaggcccagcctgaacaaacaatttaggtggagctcctggaggctggaagcagagaggaggtacctcaccatcctctcctgccagctgttgcagactctgcctggggaactgtttaagggtgagcagaggcatttatctccatgttaacaagcagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatccc

SEQ ID NO: 452820 - DNA, 2159 bp, Homo sapiens
ggcggctctgggcgccgggagtcggcgggcggcgaggagcgcggagccggagctggacgccgccgccgccaccgccacctgcgcggcagtcatcaagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaacccctgggtgacagagcgagactccatctcc

SEQ ID NO: 452821 - DNA, 979 bp, Homo sapiens
  misc_feature (135)..(135): n is a, c, g, or t
ggtgaccacgaatgacgtgcggagggagcatgtctacgactgacgagtaggacggccggccgtccaaccccgagtcttctgtggagatcgacactatagacatcgccctcgcgcctgccaggacatcactcgagncctcgtgcgcgctgccgtgtgcgccgtctcccttggtaagggcacgcgtacgaagagcactgacacacacgcggtgggcgtcacgccaagtagagcaacacgcgacgtgtggatggcaccacaagagaagagactcgagcgtagagagagatggacgttctgactggtaatttgcgcacaatgcgccgcgcaccgaggagcaccacgtagagatgcagttcgcgtgtccgtatgtctcgtaagcgcgtaacggggcaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaacccctgggtgacagagcgagactccatctcc

SEQ ID NO: 452822 - DNA, 1306 bp, Homo sapiens
tagggcgacactagagaatatcgccgactgactacggacgaagaaggagagccatgactagagagctaagccacacacggataatcagttactagggatggaggtgtgagggttcattatattattcattttactgttgtatatgtttgaaaatgtctataataaaaagctttaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcccgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggt

SEQ ID NO: 452823 - DNA, 429 bp, Homo sapiens
caccgacccatggcaaagctggctgtagggtcagtgagaggagccgcacacgctgagcccttcttctctgacacaggtgaccctggagagcatgacccagcgtccacacacaaatccacacgccctgtgaagaaggtctccagtaagtagccccacccctgtctccatggcaacagcatggctgtggcctccccaggctctggccaagtcacttccggcccatcccgagtcactgtggggcctggacctcagtgggaaagaagttggtggcagtccccaccgcggggggctgtagggctgtggcagaagctcccctgtccatcagcattgcacgtttgggctgcctggaacagcaagatgcctgaggctggcttgttttgagaaatatttactatacccaagtccttgggcagagccttgggcaaggag

SEQ ID NO: 452824 - DNA, 6223 bp, Homo sapiens
gctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattcccccaagaggtccccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccataccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcccgtcaggcttcctataatatgaaaagaagtcaccattggggaactagagaccccagaccttttcatatggatatttgagaatgtaatgcatctcaggcctcgtgctggaactctagggcactctgggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcccgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggt

SEQ ID NO: 452825 - DNA, 6287 bp, Homo sapiens
gctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattcccccaagaggtccccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcccgtcaggcttcctataatatgaaaagaagtcaccattggggaactagagaccccagaccttttcatatggatatttgagaatgtaatgcatctcaggcctcgtgctggaactctagggcactctgggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcccgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggt

SEQ ID NO: 452826 - DNA, 6608 bp, Homo sapiens
gctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctcgtaagttatgcatttctgcaactgttcgtttcttgagactgcccgagcacagaactaaatgctggtagtgagagtcgacctctctcatcagggttctgtgatgggttctatatgattccattctgtaatggcagcaggcctgaggctggaggggaggacaagcataagtgagatgaataaggtgactttagccttgtctgttttcccctgtgttgtcctgctgttcaggcgtgtgtttgtagaagtggctcttaatcagtgtggaagggagtagaggccatcccgttgctctgtatcatatttccctttccttacccccagcccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattcccccaagaggtccccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcccgtcaggcttcctataatatgaaaagaagtcaccattggggaactagagaccccagaccttttcatatggatatttgagaatgtaatgcatctcaggcctcgtgctggaactctagggcactctgggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcccgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggt

SEQ ID NO: 452827 - DNA, 5979 bp, Homo sapiens
cccaagctggagtgcagtggcggaatcacagctcactgcagcctcgacttcccgggcttaagggatcctcctacctcagcctcaagagtagctgggaccacagcctcccaagtagctgggaccacaggctcgctaattttttgtagagatgaggtttcgccatgttgcccaggctggtctcgaattcctgagctcaagcgatctgcccacctcgacctcctaaagtgctaggaggtctttaaaggcgtgcaccactgcgccccaccatctgatggtgtttagtagagggttttgaatgtcaactatgaacgttggaggttacctctgttccctcacgaagtcctggtggcacccaggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattcccccaagaggtccccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcccgtcaggcttcctataatatgaaaagaagtcaccattggggaactagagaccccagaccttttcatatggatatttgagaatgtaatgcatctcaggcctcgtgctggaactctagggcactctgggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcccgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggt

SEQ ID NO: 452828 - DNA, 1827 bp, Homo sapiens
gctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtgtgagtagcttcggggctggtgcgcggttccactggttctgtctctcctgcgccgctctgtgcagctctctgtggggccagctggccggctatatcagccactccccttcacttgtcctctactttgttgctcccttattttctcccagtcatcagtgcctttctttacttttcctaactagctcagatttcacaatcggtcctttgactctccctcttgccgtctagtctggcccaattgagctcacctttctctgtgggtcggcgcctgcatgtcctctgcagagaaggcagggcgattgcggtcaccggccttcaccgggcgtcccgttgccggcatgcctgccctgcatctcctgtctcctccccacagagagagcgtcgggtaccgagc

SEQ ID NO: 452829 - DNA, 1894 bp, Homo sapiens
gctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtgtgagtagcttcggggctggtgcgcggttccactggttctgtctctcctgcgccgctctgtgcagctctctgtggggccagctggccggctatatcagccactccccttcacttgtcctctactttgttgctcccttattttctcccagtcatcagtgcctttctttacttttcctaactagctcagatttcacaatcggtcctttgactctccctcttgccgtctagtctggcccaattgagctcacctttctctgtgggtcggcgcctgcatgtcctctgcagagaaggcagggcgattgcggtcaccggccttcaccgggcgtcccgttgccggcatgcctgccctgcatctcctgtctcctccccacttggcatctggtgtggtaccgcctccaaacaggctggaaatggtgttgccaagtttggtgagagtagattcctcttctgcgctgtcctct

SEQ ID NO: 452830 - DNA, 1510 bp, Homo sapiens
gctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccagtaagtagccccacccctgtctccatggcaacagcatggctgtggcctccccaggctctggccaagtcacttccggcccatcccgagtcactgtggggcctggacctcagtgggaaagaagttggtggcagtccccaccgcggggggctgtagggctgtggcagaagctcccctgtccatcagcattgcacgtttgggctgcctggaacagcaagatgcctgaggctggcttgttttgagaaatatttactatacccaagtccttgggcagagccttgggcaaggag

SEQ ID NO: 452831 - DNA, 291 bp, Homo sapiens
gtaagttatcatgggcaaggagctttggggtgtccactctgagtttgttctgcaaatcactctctgtttcctctcccagctgcagccaaagccaccagctcacatccgaactcaacatctctcaaggccaaggtgctggagaccttcctggccaagtccagacctgagctcctggagtgtgagtagcttcggggctggtgcgcggttccactggttctgtctctcctgcgccgctctgtgcagctctctgtggggccagctggccggctatatcagccactccccttcact

SEQ ID NO: 452832 - DNA, 120 bp, Homo sapiens
actgatggcggtccaggaagggtggaggctaaacctccttggcatctcagcagtgttaagtctctgggttgtaatgggcttctgctattaccatgtttctcaactgtttttttttttttg

SEQ ID NO: 452833 - DNA, 6169 bp, Homo sapiens
gctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattcccccaagaggtccccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccataccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggtttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcccgtcaggcttcctataatatgaaaagaagtcaccattggggaactagagaccccagaccttttcatatggatatttgagaatgtaatgcatctcaggcctcgtgctggaactctagggcactctgggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcccgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggt

SEQ ID NO: 452834 - DNA, 5679 bp, Homo sapiens
gtatctagaggatcccaggcgcggtctgaactgtcctctgaaaaggatgaagggaagtagccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattcccccaagaggtccccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcccgtcaggcttcctataatatgaaaagaagtcaccattggggaactagagaccccagaccttttcatatggatatttgagaatgtaatgcatctcaggcctcgtgctggaactctagggcactctgggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcccgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggt

SEQ ID NO: 452835 - DNA, 5798 bp, Homo sapiens
agttcgacggagactctcattctttaatgccatcctggcagacatataactttctggttacttataataattaaaaagttcgacggagactctcactattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctcgtaagttatgcatttctgcaactgttcgtttcttgagactgcccgagcacagaactaaatgctggtagtgagagtcgacctctctcatcagggttctgtgatgggttctatatgattccattctgtaatggcagcaggcctgaggctggaggggaggacaagcataagtgagatgaataaggtgactttagccttgtctgttttcccctgtgttgtcctgctgttcaggcgtgtgtttgtagaagtggctcttaatcagtgtggaagggagtagaggccatcccgttgctctgtatcatatttccctttccttacccccagcccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattcccccaagaggtccccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcccgtcaggcttcctataatatgaaaagaagtcaccattggggaactagagaccccagaccttttcatatggatatttgagaatgtaatgcatctcaggcctcgtgctggaactctagggcactctgggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtatagtcctgagttctgtgatttttagtgaatcattgaacctgaggaagatcatggtaccctcctgggattgtaggcagttggtcacaagcgctgatggcctgggatccccacatggggctggtgtctgaggtgagggcagccctgttggggactatgtcccttcgctggtggcatctgatctaactctgctggtcgttgttagaattgtggtgcggtacaccaggtggtgtcagaacagaggcggtgggatctgcacaccttgagtaagcccttctcgaccagcctgttggaacaaaacacactactcttcatgggagcctcccgagtttcttctcacctgtgtgaagtcccctttgtttactgtcctgagttttgttctcgctcatctccaacccctcttgtagttttttcttcctcactgtcactgtaaccataaaaatactcagtatgtcagtgatagacttgtctttctattcagagatgactcttcaactgtccggggacacttttttccaataaaaagttcaggatggt

SEQ ID NO: 452836 - DNA, 1906 bp, Homo sapiens
gctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccctggagagcatgacccagcgtccacacacaaatccacacgccctgtgaagaaggtctccaaagaggaaaagaaatccaagaaacctcgtaagttatgcatttctgcaactgttcgtttcttgagactgcccgagcacagaactaaatgctggtagtgagagtcgacctctctcatcagggttctgtgatgggttctatatgattccattctgtaatggcagcaggcctgaggctggaggggaggacaagcataagtgagatgaataaggtgactttagccttgtctgttttcccctgtgttgtcctgctgttcaggcgtgtgtttgtagaagtggctcttaatcagtgtggaagggagtagaggccatcccgttgctctgtatcatatttccctttccttacccccagcccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggcgcgcccccggagcaggaggcagcccccgcggaggagcccgcggccgc

SEQ ID NO: 452837 - DNA, 604 bp, Homo sapiens
tctccagcaccttggccttgagagatgttgagttcggatgtgagctggtggctttggctgcagctgggagaggaaacagagagtgatttgcagaacaaactcagagtggacaccccaaagctccttgcccatgataacttaccctccaagccagcttgttttaaatccactaactcttcctggccaagtccagacctgagctcctggagtgtgagtagcttcggggctggtgcgcggttccactggttctgtctctcctgcgccgctctgtgcagctctctgtggggccagctggccggctatatcagccactccccttcacttgtcctctactttgttgctcccttattttctcccagtcatcagtgcctttctttacttttcctaactagctcagatttcacaatcggtcctttgactctccctcttgccgtctagtctggcccaattgagctcacctttctctgtgggtcggcgcctgcatgtcctctgcagagaaggcagggcgattgcggtcaccggccttcaccgggcgtcccgttgccggcatgcctgccctgcatctcctgtctcctccccacagagagagcgtcgggtaccgagc

SEQ ID NO: 452838 - DNA, 534 bp, Homo sapiens
  misc_feature (29)..(30): n is a, c, g, or t
gcctcaacacgcgcgtttttggaaggggnngaacccaggtaaacaaaaagggctgccccttttaatggtactttggggtacacaaaaggcaacataagaatgtaatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtg

SEQ ID NO: 452839 - DNA, 3930 bp, Homo sapiens
atctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtg

SEQ ID NO: 452840 - DNA, 2791 bp, Homo sapiens
cttccatgaggacgcgctccccattttcctccagcatggccacacgaatggatctgatgacaagggccactgagaattttcaacccaagaagagaaaaatatgtactatatcaaacaaccactagcgagctgagagaaacgtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtg

SEQ ID NO: 452841 - DNA, 4424 bp, Homo sapiens
atctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtgcttgatcatctctccttgggtttttctttaaaaaggggaatctgctataaaggttctgttgcttcaaaccaatgtcaaatagacttgatttttagagtcatggaattacagtgcaaccttgatttttattcccctcactgctatgagtgtgggcaggtactggtttatatgttataacttccgttttatctgtgttgtgtagttgaatggcttaatcgttgagtggtaaaataaaagattatattccaatacaagaatcctggaaagatttatgtgaatgacattttaagtaggcgcatctttgctgtttcttgtattctcgccattgctctgaccactcccttgcttgccctgtatatatacaaaaacttgtaggtgtgcacgtgtgcttgtacttctgtcttccatttctatcttaatctcttaaacatattgcttaagccactaagatgtccttgtttcaagtaaatcgtcacattgtgacacctggtgta

SEQ ID NO: 452842 - DNA, 4589 bp, Homo sapiens
atctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtgcttgatcatctctccttgggtttttctttaaaaaggggaatctgctataaaggttctgttgcttcaaaccaatgtcaaatagacttgatttttagagtcatggaattacagtgcaaccttgatttttattcccctcactgctatgagtgtgggcaggtactggtttatatgttataacttccgttttatctgtgttgtgtagttgaatggcttaatcgttgagtggtaaaataaaagattatattccaatacaagaaaaaaaaaaaaaaaaaaaaaaaaaaaaaaaaaaaaaaaaaaaaaaaaaaaaaaaaaaaacaaaaaacaaaagaaaaaaaaacaaaaaaaaaaaaaaaaaaagcacatgggggggccgccgccaggacacaagaaactcacagcaacaacagaggggggcggcgcgccacaaaaagaagagaaacaaagagagaagaaaaaaggccgagaccaaaaaacacacagctgttgtggcgaaaaaagggggggaggagagaccccaccaagaaaaaaaaaaccggcggcggggagaaaaagaagagaggtagaaaaaaaacaacacagagagagtacgcgagggaacaaaacagggagggaataaagaggggagcaaacacagagaaacagaaaaaaaaaaacacccg

SEQ ID NO: 452843 - DNA, 3891 bp, Homo sapiens
atctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaattaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtg

SEQ ID NO: 452844 - DNA, 1072 bp, Homo sapiens
cgattaagccattctactacactacacagataaaacggaagttataacatataaaccagtacctgcccacacccatagcagtgaggggaataaaaatcaaggttgcactgtaattccatgactctaaaaatcaagtctatttgacattggtttgaagcaacagaacctttatagcagattcccctttttaaagaaaaacccaaggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtgcttgatcatctctccttgggtttttctttaaaaaggggaatctgctataaaggttctgttgcttcaaaccaatgtcaaatagacttgatttttagagtcatggaattacagtgcaaccttgatttttattcccctcactgctatgagtgtgggcaggtactggtttatatgttataacttccgttttatctgtgttgtgtagttgaatggcttaatcgttgagtggtaaaataaaagattatattccaatacaagaatcctggaaagatttatgtgaatgacattttaagtaggcgcatctttgctgtttcttgtattctcgccattgctctgaccactcccttgcttgccctgtatatatacaaaaacttgtaggtgtgcacgtgtgcttgtacttctgtcttccatttctatcttaatctcttaaacatattgcttaagccactaagatgtccttgtttcaagtaaatcgtcacattgtgacacctggtgta

SEQ ID NO: 452845 - DNA, 786 bp, Homo sapiens
aggagtctgctggataggtatcggagaagggtgttatgttcaggtttaaattgaaagaaaatgagaaaccagataaagcaagccaaccaaattaacttcactttgtgctcctctctgcttttttgagcttgatcatctctccttgggtttttctttaaaaaggggaatctgctataaaggttctgttgcttcaaaccaatgtcaaatagacttgatttttagagtcatggaattacagtgcaaccttgatttttattcccctcactgctatgagtgtgggcaggtactggtttatatgttataacttccgttttatctgtgttgtgtagttgaatggcttaatcgttgagtggtaaaataaaagattatattccaatacaagaaaaaaaaaaaaaaaaaaaaaaaaaaaaaaaaaaaaaaaaaaaaaaaaaaaaaaaaaaaacaaaaaacaaaagaaaaaaaaacaaaaaaaaaaaaaaaaaaagcacatgggggggccgccgccaggacacaagaaactcacagcaacaacagaggggggcggcgcgccacaaaaagaagagaaacaaagagagaagaaaaaaggccgagaccaaaaaacacacagctgttgtggcgaaaaaagggggggaggagagaccccaccaagaaaaaaaaaaccggcggcggggagaaaaagaagagaggtagaaaaaaaacaacacagagagagtacgcgagggaacaaaacagggagggaataaagaggggagcaaacacagagaaacagaaaaaaaaaaacacccg

SEQ ID NO: 452846 - DNA, 651 bp, Homo sapiens
cttgaaaacacttaaatgtgtgtttccttgcaatataactttttctttttttatttaaataagtcttataaatgtgggaaaaaattatcttgtgttcctttaatttcatttttatttaatactattttcagaatgaacaaaagattgaaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452847 - DNA, 530 bp, Homo sapiens
cttgaaaacacttaaatgtgtgtttccttgcaatataactttttctttttttatttaaataagtcttataaatgtgggaaaaaattatcttgtgttcctttaatttcatttttatttaatactattttcagaatgaacaaaagattgaaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccac

SEQ ID NO: 452848 - DNA, 175 bp, Homo sapiens
tcaatataagaaaatcctcttaggaaaaattgtacattgtaattatgtttggttgcatggctgtcttatttccctttgatagatttagagacctcccaaagatttcttgattagtgataaacttagttatccactaatggaaaggaacagtgatgcatgtagattatagaaaatc

SEQ ID NO: 452849 - DNA, 1981 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452850 - DNA, 2229 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaaggtgaggcgcggattggagcaaagttgtggagctgggctgggctggggggcaacggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttgaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452851 - DNA, 1654 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452852 - DNA, 1076 bp, Homo sapiens
ttgtcttttgtgtgatattatctaactgaaactgtgaattaactggttagggtctatgcattgctgttggacagtgaccattctcatatgggctttgcatagctcatccttttctcagggtgtgggtgatgaagtagctggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452853 - DNA, 980 bp, Homo sapiens
tgatatgtgaattccggatactagagtgtagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452854 - DNA, 807 bp, Homo sapiens
ccgggttgtactgcgattattgatcaaggcacaaatccgtctcagagacgcagagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452855 - DNA, 885 bp, Homo sapiens
aacttcaatccgctataaagaactttaaaagagaaaatttcatctaaatatttcacacttaaaggaaagccttaccaactatggcaacaggtttggaccatgaaatagtactttcctagatgacatatcgagtcaacatgaagccttagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452856 - DNA, 1964 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacggggaaaatttgggaaacctgagtatttttaaaataggattataaattttgtgccgggccggcaatttattatgttgttatgct

SEQ ID NO: 452857 - DNA, 2113 bp, Homo sapiens
  misc_feature (2111)..(2111): n is a, c, g, or t
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtttatggtaatgtaagtattgtgttactaaaccttactggaagaaaagaaaatgttatcacccccagacatgttataatgtagggcagaactcaaagggaatgggacattccctttgatgaatggttcttttaatgagatttttcatgatttaagtcattttaggatgattttaacgtcttccttctagtagtgtagaatcttcatatgagtagaccccaggagagcctgattctaatcagtcttatggaaaggctgagaatcctgtngt

SEQ ID NO: 452858 - DNA, 1640 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagtgcagaaaccagaccgggtcctctagatcagcc

SEQ ID NO: 452859 - DNA, 1341 bp, Homo sapiens
  misc_feature (1326)..(1326): n is a, c, g, or t
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagataactggagctgttgtaactagagctgttgtanctggagctgttgtaa

SEQ ID NO: 452860 - DNA, 1315 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagcttgagacacggatgtccaccacctcacagctggaggaagctgagcataaggttcagagcctacaaacagccctggaaaaaaactcgaccagaattctttgacctgaaaaccaaatacgatgaagaaactactgcaaaggccgacgagattgaaatgatcatgacggaccttgacag

SEQ ID NO: 452861 - DNA, 420 bp, Homo sapiens
tgatagatttagagacctcccaaagatttcttgattagtgataaacttagttatccactaatggaaaggaacagtgatgcatgtagattatagaaaatcaaacactgaatattctgattctcaattaatgttattttcaaatgattttgattatattagtattaatttgtattattcaatttttttccccagtatgagaataatgttatcactattgatctggttcaaaattcttctcaaaaaactcagaatgatgtggacatagctgatgtggcttattattttgaaaaagataagatgtgagtatcatcttctttattcctgtgttcaggaatgtagtctatcatgcctcaatgaattaaatatatttcatcacctttttatccacttacagatcaaccaaatggttcgctgctgccg

SEQ ID NO: 452862 - DNA, 2001 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452863 - DNA, 1880 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccac

SEQ ID NO: 452864 - DNA, 1239 bp, Homo sapiens
gaatcgagctcggtaccgaatctcatagttgtgccaaaatactgtcatttggtcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452865 - DNA, 2299 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaacttggaaaaaaaaaaaaaagaaccatcaacgcgccccttactcaacagagacgacaccacacaggaaaaaccacagaggggcgcacccaatcccccgagaaaagctgtcgacaaccacaatgtgggggcagcgcccccaacaagtgacgaacagtggcacgaagacaccgaaaaagagggcggcgcgacgcggggtcaccccataaaaaacgccgggcgccgcgtcgaaaaaaccagggattcggaccgagcacacggggcagactaaagcccgacggggagaaaagagagggccgcacac

SEQ ID NO: 452866 - DNA, 856 bp, Homo sapiens
gtcggagtcacgccatgtcacaacacgctcctgcatgtgcaggcttcttcatgtactcctccttctggttttctccgcagctagcctgggggccggggtcttctcctccgaggttgctggctgcagtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaaatttcttaactt

SEQ ID NO: 452867 - DNA, 1530 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactagacacaggctcaagaaggaagaagcccaattgtgcttaagaagttggggacagaggacgaaaatgggaactggtcaagcccagaggcggcactgtcagcccaggtgaaggacactagggagagacagtcatgctgactcacagaccatctg

SEQ ID NO: 452868 - DNA, 1385 bp, Homo sapiens
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatatcactaagactagtgtacagatgcatccttcctgtctgtctaacgacatcgcaccggaccgtaattcgagggtacatactcggtctccgt

SEQ ID NO: 452869 - DNA, 1060 bp, Homo sapiens
  misc_feature (1038)..(1038): n is a, c, g, or t
caaagagcaagagctgtagagtctagccctggggtgaggatgccacggctacccggctcctccacgttcctctatccagttcccgcacccttccccccaggccccattcttcaaggcttcagagcagcgctcctccggttaaaaggaagtctcagcacagaatcttcaaacctcctcggaggccaccaaagatccctaacgccgccatggagacgaagcacctggggcggggcggagcggggcgcgcgggcccacacctgtggagagggccgcgccccaactgcagcgccggggctgggggaggggagcctactcactcccccaactcccgggcggtgactcatcaacgagcaccagcggccagagcgtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactttgcatcnagaggacactttgcatccagag

SEQ ID NO: 452870 - DNA, 2657 bp, Homo sapiens
tgctcatgctgcctgccacagtgctgctctatcgcaagctgggcatcatcctcatgatggtcaaatgcgtcagttgtggctttgccagcttcttcttccaatctctctgctgtttcttcgggccagagaagaactgtgggcagatcctctggccctgtgcccacctgccatgggatgctggtactggggaccctggtggggagaaggcaggccgcccacgaccagggtcagtgggagggatgcccgggtcctgctcagagcaatatgagctacagcccctggcacggcgtcggagccccagctttgacaccagcacagccaccagcaagctgtcccaccggccctcagcactctctgaggatctgcagctccatgatggtccgtgctgttcccggcccccaccagcccctgcctccccaagggagctgctgctggaccaccaggcagtcttcagccagtgccctgccctgcagacctcctccccctataagcaggctggccccagccccaaaacccgggccaggcaggactcccaaggggaggaggctgagcccctgccagcctcaccagaagccccagcccactctcctaaggccaaggctgcagatcctcctgatggcttctgttcctcagccagcaccctggaggggctcagcgtctctgatgagacctgcctaagcacctctgagcccagtgcccgtgtaccagattccgtgggtgtgtccccagatgacctggatgacactgggcagccagtccttgagcgaggccagctcaatgggaagcgggacaccctgtggctggcgctgagggagacagtgtatgacccatcattgcccgcttcccatcacagcagcttgtcctggaagggccgaggggggccaggggatggcagccctgtggtgctgcccaatagccagccagacctgccagatgtttggctgcgcaggcccagcactcacacatcaggctatagcagctgagggggacccggggaggctggacagggcgcggaaccctgtcatggatgacaaggcaagggcagcaataggctggagcccgaaggtatttctccagatccacagggagaggtctcaccctccagctgtggatgttaaaccctgccagatgtcccagccttgatctgtctgctcctactcctcacatctggaggattccagcaggaggggttttggaggggacctgcttgcgacctgctgagggcttgtctgctcccacagcaccatctaagacccctcctctagaagtggggaaggccagatgtgtagcttcgggtatcagaggaggctgacctggcccccatcccaagttacaagaacttcagtgagactaagggacccccatcctagggatcttgtcagggttccttactgaccagaggagcccgcagcaatctccacagcctcctgggtctcacccctttcatgggctcttcatcaggacacttccctctcttttgggagcttctctgggcagaattgggctgggacctctctccccaactgccctgctctcctcatactcaccggtttgaccagaaattgtccaaatccagccatagatggctgctgggtgtgcagcaggagaaggaggatggtcagccttggagcatctctcaattacgggacagtccctctttggaagcaggctcctgtgctttcctgtgttaataaacagtaataatcctttccatctctgcacattttagtctccttggaatctatctcactacttcactacagggtagcctgacattggtcaggttcttttgacacccaatttataggtaaagacattgagactaagtaagatgaactgacctcagggtcacttagccactaaatggcagagcggtttcattccaccactacaacctccagtttccctttggctacctgccttctttcaccgctagcaccctcctccaatctgctttctctggtgtctctgactgaatccagaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452871 - DNA, 717 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtaacccactccgggtcctattctttacaaccttctcaatgttctggctccattggactagcctacctggcaagcttttcacactggggcccgttcttgggccacgtggtc

SEQ ID NO: 452872 - DNA, 453 bp, Homo sapiens
  misc_feature (25)..(25): n is a, c, g, or t
gcggccgcctactactactaaattngcggccggtcgacctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452873 - DNA, 237 bp, Homo sapiens
  misc_feature (25)..(25): n is a, c, g, or t
gcggccgcctactactactaaattngcggccggtcgacatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452874 - DNA, 4576 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaacaccaaaaaaaaaaaaaaaaaaaaaaaaaaaaaaaaaaaaaaaaaaaaaagaaaaaacaaaagaaaacaaagagaagaggagggcgcgcgcgccgccacaaaagaatcatccatccccgagagcggcccacacatcacaacgacccaccaccagttgcctcgcacacaagggggccccacacatgcggacgtcataatacaaccgccagcgagacggcgcggcccataaaacaacaccgccgccgcatgagcggggaacaacacgggaccaacgagcgacaacccttgacgacagaaaggaccacccacatacatcgcgaggggggaacaacaaacaggcggcgacccacaccgacccacgaaaaagaaattaacacagccgcccaagggcgcaccacaccaaaagagctccacccggccggctatacaagggcca

SEQ ID NO: 452875 - DNA, 3381 bp, Homo sapiens
  misc_feature (3219)..(3220): n is a, c, g, or t
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgaggnnaagagggactggtttatctaccattagctccctcaatttgctgtccgaactatgatactaactatttgtcgaccattaagcgcacctgtggaacacccctattatcccctttccttattccagctcccctttcttttctcctccccccccacgagattata

SEQ ID NO: 452876 - DNA, 1423 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatcggcccctcgccctttaacattggggcaccggcgcgaacacccacttaaaccagaccagcaaaagaacctccccacgactcgcgggggcggccccct

SEQ ID NO: 452877 - DNA, 3904 bp, Homo sapiens
gtaatattgagagaggttcggtaagatatttttttggtgggagaaaaatttcattatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452878 - DNA, 1512 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattcatgcaattgcatatggcaaggccaagacaacaggaaatctgtcaatccttttgagttggcaagtttgagaatttacccagagggctgttttatgcagaagcctcagctatcaaggctcaaagtccctgagaatgctcaggttcaacggagaaggcaggcaatgtaaggttacagtactgagaatgtgggcttgggaaccagacagagctggctgggttccaatccctgcttactaggtactagctctgtgatggtagggaattacttctcctctctatgccttgggctgctttctgtaaaatggggaaaataacacatgcacctcacagagctggctgggttccatacctgcttactaggtactagctctgtgatggtagggaattacttctcctctctatgccttgcc

SEQ ID NO: 452879 - DNA, 3820 bp, Homo sapiens
ccccctccccccccccctcctcctctcctcctcccccaccttaccgctaggtacgaggctgtgtgttaactcggccgaggagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452880 - DNA, 795 bp, Homo sapiens
gagacagagtctcgcttttcgcttttttgcccaggctggagttcaacggcgcaatctcggctcactgcaacctccaccttctgggttcaagtgattttcctgcctcagcctcccgagtagaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452881 - DNA, 613 bp, Homo sapiens
aaaaatgtgaaagaccaacaggaccggaagccaacaagaggaactcacctataccgacgggcccaaccccaaaaaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452882 - DNA, 490 bp, Homo sapiens
atctccgaccagtctgggggcgctggcggcctgcgcagccacctcaaggtgcggcattgggcgacgtggggccgggagggaagacggcaggcttaggcgaggggaggctcgggttcgggggagtcgggccggcggaggcctgggagttgttctggcctcccgggagcgcaaaggacgtgcggtggagcccgccccctcaccccgctggttgcctgtcgcggggcggggcgggtcaccaacgcctgggaaccccaagaagggctgcgaggctttggcggatgtggtgacacctgagctggggcggttgtcaacgtcctataccagttttggtctcagatacattgaaccgtaatttggttctccaaataaatgttggggtgttgaatatttatacggattggcatcataagataccgcgatacctgcaggaaagtaaaggagacagagctaaccgtgattaataaaatgttatttattgagcatctgctgt

SEQ ID NO: 452883 - DNA, 269 bp, Homo sapiens
tcccagaattttaagtatttcacacaatgattcctttgatttctttctcaggaacagggcggatacctgaccaactcgtgatcctagacatgaagcatggagtggaggcgaaaaattacgaagaggtatgtcctgctctaacagccagaggaggcagcagtgtgctatgctgtgaggtttctgtgacctcggcaggccaacaggctgtgctttgcccaaagggctgtggtttcttagcagtcttgtgacagccagccatgatcttactg

SEQ ID NO: 452884 - DNA, 1367 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttga

SEQ ID NO: 452885 - DNA, 4141 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452886 - DNA, 4091 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaagtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452887 - DNA, 2983 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagagtctccgtcgaactagttcgacggagactctctgattcctctgagaaagcagaagcctgtggctttctctaaggactgggagacagaaacaacttggtttgtactttcttagagtggagtagatcccagagagaaggga

SEQ ID NO: 452888 - DNA, 4084 bp, Homo sapiens
tgaggcacggggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctgcccattaactctcgcaagtgcctccgtgaggagattcacaaggacctgctagtgactggcgcgtacgagatctccgaccagtctgggggcgctggcggcctgcgcagccacctcaagatcacagattctgctggccatattctctactccaaagaggatgcaaccaaggggaaatttgcctttaccactgaagattatgacatgtttgaagtgtgttttgagagcaagggaacagggcggatacctgaccaactcgtgatcctagacatgaagcatggagtggaggcgaaaaattacgaagagctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452889 - DNA, 3778 bp, Homo sapiens
agcagggggaggagttgtggctgtttccctctattgagagggaacagggcggatacctgaccaactcgtgatcctagacatgaagcatggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452890 - DNA, 4073 bp, Homo sapiens
  misc_feature (357)..(357): n is a, c, g, or t
  misc_feature (361)..(361): n is a, c, g, or t
cgagtgctctactgcgggtgctctactcgcgggtgttctacctcgcgtgtgctctcctcgctcctagatgggatggcggcgggcagagacgctcctcactttccagactgggcagccaggcagaggggctcctcatatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagccttggcaccattgagcactgagtgaacgagactccgtctgcaatcccggcacctcgggaggccgaggntggnggatcactcgcggttaggagctggagtggaggcgaaaaattacgaagagattgcaaaagttgagaagctcaaaccattagaggtagagctgcgacgcctagaagacctttcagaatctattgttaatgattttgcctacatgaagaagagagaagaggagatgcgtgataccaacgagtcaacaaacactcgggtcctatacttcagcatcttttcaatgttctgtctcattggactagctacctggcaggtcttctacctgcgacgcttcttcaaggccaagaaattgattgagtaatgaatgaggcatattctcctcccaccttgtacctcagccagcagaacatcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacaaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatgtacaggtttttatgtgaacatacattttcattttctgggataaatgctcaaaagggcaactgttgggttgtatggtaaacacatatatttttgtaagaaactaccctactctttttccagagtggctctactttttacatacagccactcatacaattcagacagcaatgtatgattgatccagtttcttcacatcctcaccagcatttggtattactactattttttatcttaaccattcacatagatgtgtgtaatgataccacatgtggttttaatttgcatttccaatggctaatgatgttgagtatctttttgtgtgctaatttgccatctatgtatcctcttcggtgaaatgtcttcatgtcttttgtctattttctatttaggtcatttgttctttttactattgagttttgagaggttttttatatatcctagataaaattcctctgttagatatgtggttgcttgaatttttaacataacttctaccaaggaaaaataagtaaaatttccaacccttgcatggccagtcacttacttaattcctgtccttcagtgttccatctagagaattaagagatatgatgtataaaatagacatcgagggccattaagagagtaaatacttaaaaatacatgttatgaaagcaaagccaataatcactgtaggagtatgagttgcctaagggccaaaactaatgtaaataagagaaagtgtggatataaatgaccattgtttataaacagttatgaaaaatgctgtgacttgaaatctttcccacatctcccaagaaagtaggtaggagtttatcctttccgtaatctctttttaaccctgctgactattacagggcttgtttaatcacagtggcaagaattacatgtatcttacagtaaagaaacagaatactggaatcgttagagaaccctgatgtgttgacctggataaagtacaaaggtggaagagggaatgagttatgctgttaaaatctcaggctattctgttaatgttcctgctactatgaacccaaactttttttttcccccttttgactccttgtgtcttcctctcctgtggcataaaagtagttctgtcgttaacttgtacaacattgccatctgctgttgagaattggtaggtactgcttctgagaacctggctgcagatccttagcataggcagcaaatgttgagaaagtctatctgtagtattacatatactaagttacagaggatgcattcaagtagagaaaataatatgtgggttaagatacatccttaaactttttttttttgggggggggggggacggagtcttgctgcaacgcccaggctggagtgcaatggcactatctcagctcgctgcaaccttcacctcctgggttcaagcaattctcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagaatattttatttcgttgatgcttttgttcccaagtgtgaccctaaacttaagctttgtaggagttgacattctttcatgtcccttccctttactcatgccgaaactatcaactgggacattttgtgcttttggtttaaaagttaattgatattatactttggttttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagcagaaac

SEQ ID NO: 452891 - DNA, 641 bp, Homo sapiens
gatagcagccttttaaggtccctatcaaggctgctatctctggatttaaggtttggcctccaagtcatgagtcttgagttctgagatagcagcctcgatagggaccttaaaaggattcacaaaaacttttgccacacttggtgcctaggccctgttcctaataaccccttctagggccgtttatccaacatttagatgccttcttttccctccctaatttgtagccagtccaacctttcattccttggaggatttagttttgggataaaattttggtccttgggcacagagacattcactattaatgaagtaacccttgggcatgactccaatcccagaattgctcactgagcgctatgccaccgaagcgttgacctgaacatattagtgcaatccagtccagattggacctttgatcctatgtggaagggctgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttttactgct

SEQ ID NO: 452892 - DNA, 2968 bp, Homo sapiens
ccccaaatctgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgttcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaaggtggtgttttcatttttgtataatactttaatggaatgctttttaaaaaaatataaaaccaaggtaaattattgtttcatcttcacgtatggatgctagtgcctttaatggaaggtaaagaatgttttgctagttagaagtacatattgaggttttaatggtggtgatagtgagttttgtggcaccagctgttttttattttaaactttctgagcatccggcaaggtacaggttttgatgttcaagttttattgggataagatcttttgatcccaaggtcaggtggatggaatttttggatttatatttgttccttgagtcttcagggcagtgtctccatgagggttttcctgttgaggggcaccacatacaatagtgtgaagtaggtatgaggggcagtcattgtattctatagtttttttatgtagtctacatttctcagatgtatccccattcggttttattctcagaactgttactagactcatgacttggaggccaaaccttaaatccagagatagcagcctcgatagggaccttaaaaggattcacaaaaacttttgccacacttggtgcctaggccctgttcctaataaccccttctagggccgtttatccaacatttagatgccttcttttccctccctaatttgtagccagtccaacctttcattccttggaggatttagttttgggataaaattttggtccttgggcacagagacattcactattaatgaagtaacccttgggcatgactccaatcccagaattgctcactgagcgctatgccaccgaagcgttgacctgaacatattagtgcaatccagtccagattggacctttgatcctatgtggaagggctgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttttactgctgttaagtttgttatttgggtataaaaccagatgtttacacctgtaaaa

SEQ ID NO: 452893 - DNA, 326 bp, Homo sapiens
tggactggattgcacaaatatgtcaggttggacctttgatcctatgtggaagggctgttttttcttaaaaaaacagcccttccacattaggatcaaaggtcaatttttgaattgccttgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttttactgct

SEQ ID NO: 452894 - DNA, 2920 bp, Homo sapiens
ccccaaatctgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgttcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaaggtggtgttttcatttttgtataatactttaatggaatgctttttaaaaaaatataaaaccaaggtaaattattgtttcatcttcacgtatggatgctagtgcctttaatggaaggtaaagaatgttttgctagttagaagtacatattgaggttttaatggtggtgatagtgagttttgtggcaccagctgttttttattttaaactttctgagcatccggcaaggtacaggttttgatgttcaagttttattgggataagatcttttgatcccaaggtcaggtggatggaatttttggatttatatttgttccttgagtcttcagggcagtgtctccatgagggttttcctgttgaggggcaccacatacaatagtgtgaagtaggtatgaggggcagtcattgtattctatagtttttttatgtagtctacatttctcagatgtatccccattcggttttattctcagaactgttactagactcatgacttggaggccaaaccttaaatccagagatagcagcctcgatagggaccttaaaaggattcacaaaaacttttgccacacttggtgcctaggccctgttcctaataaccccttctagggccgtttatccaacatttagatgccttcttttccctccctaatttgtagccagtccaacctttcattccttggaggatttagttttgggataaaattttggtccttgggcacagagacattcactattaatgaagtaacccttgggcatgactccaatcccagaattgctcactgagcgctatgccaccgaagcgttgacctgaacatattagtgcaatccagtccagattggacctttgatcctatgtggaagggctgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttttactgct

SEQ ID NO: 452895 - DNA, 595 bp, Homo sapiens
aagagacaacttctgttgggtgttggccagtgtccctcgtccccccaccctgggtccccactgctttacctcttgctttgcagccttctctcctcacagccttcctgtggctgtgtttttggccctgatagccccatggcacaactgcactttgcctcacctaggcctgtggcttcttgcctggcaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaagtgagagggttggggaccaaaacaccttccacaccaaactacttccgtgtttggataaagtgtggtgggcacagcttctgagtctgagagggaggaaggctcatggtttctcttcccacaaagccatccccagggatcctgtcatcacat

SEQ ID NO: 452896 - DNA, 324 bp, Homo sapiens
ttacaaaaacaggcagtgggctagtttggcctgtgggccatagcttgccaacccctggtttagaacataacaagagtctttctatgctgtggtgtagcatatcggtaagagtgtaaatctgaagctacaatactaggttcaaatcccagctttactacgtatcagctctttctctgtggcttcattttcttatttgtaaaatgggggtattagtagtatacattgtaagactgtcataagaaataagttcatgtgtgtaatgcacttagcacagtgcctgacacatggtaaacagtaagcgttaatgatgatgaagataatttg

SEQ ID NO: 452897 - DNA, 5798 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452898 - DNA, 5607 bp, Homo sapiens
aagagacaacttctgttgggtgttggccagtgtccctcgtccccccaccctgggtccccactgctttacctcttgctttgcagccttctctcctcacagccttcctgtggctgtgtttttggccctgatagccccatggcacaactgcactttgcctcacctaggcctgtggcttcttgcctggcaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452899 - DNA, 5957 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagtaaaaaaaaaaaaactcgagggggggcccgtgaccaaattcgcctaaagggagccgattcaaattaactggccggggtttaaaacgtcgggactggaaaacctggcttaccaacttaatgctttgaaacatccccttttcccgctgcgtaattgaaaaag

SEQ ID NO: 452900 - DNA, 5606 bp, Homo sapiens
atccctgcactagaatattgtagctaaaatagagtgagacaggaagtaaccctgaagtttggaattgttcctattcttggctcagccaggccttgttctcctgctgggtgtctgtacctggagcagttgctgtgcagatttgatgagtcaaggtcaccttggacatacagagcccatttgagaaagtatgtgtgatggtgctttgtaaacggtgaagcctgctagtgacgttggggcttttggttgctgttatggcctggatgagttggtagcccctgctggctctagagactttggtctaaccccctgaggtaggcctctggaggcttcgaatgccaagggcattacggtttcttctgttttgtcagacacgcaatgctgatgatgagtacctggtcacgtccattgctaaagcctgtgccctggacccggggacaagggccactgggggctccctcagcaccgggaataatgataccagcgaggcgtgtgatgctgactttggtaaggtgtggatgatgctaaccccccagggagcaggccccctccttggcttcattggctcccagggagtccccagtgagagtctgggaagatgacaacacacggggtgctggggtccctgccttgtcagaagctgtggggtatgaggggtctctagttgcatgttctgccttctgagagggagtgccagagggccagcaagaggttgggtggctggctgactcagggactccttcctgctgtgtgtttagattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452901 - DNA, 4325 bp, Homo sapiens
agctccttgtcctcagggtggctgtgtggggggcggcctacctctgagatcttctggaactggttgttggactggctgcacttctcagctgtctccagagcgactttatagttatcgacaaacgctttgtacacaccgagccggggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452902 - DNA, 2801 bp, Homo sapiens
aatgtgtataggtgcgggctggtggtatttcagtagagggcaggcttcaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452903 - DNA, 5568 bp, Homo sapiens
  misc_feature (5234)..(5234): n is a, c, g, or t
  misc_feature (5238)..(5238): n is a, c, g, or t
  misc_feature (5250)..(5250): n is a, c, g, or t
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagtaaaaaaaaanaaanaaaaaaaaaaanaaaaaaaaaaaaaaaaaaaaaaataaaaaaaaaaaaaaaaaaaaaaaaaaaaaatagtggtgggcggcccgcgccgccggccacacgaggaaaaaattttaacaaaccacctggggtggggggcgaggcgcgaccccaatgatgatatgaaacaaggtgtggaacaagacgtgtcccagagaagaaatcggcggcagacaggggggtggctccccccaaaaaaaagacggcggggacacgagggtgtgaacaccacaaggacatgtggaggcaagggggacaacagagagccacgaagcgagaaaataaccgcgccgg

SEQ ID NO: 452904 - DNA, 4259 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtccgtcgattcgacggacgcattcacgcaacttcataaaaaacacctgagggagagaccactggctttgattagcaaataaggtatgaacctgggccagttgcccacattcacacagaccactggcccagggacatcctcctcatatgatagcattaaggcacatgctgtactgtgagccagcacttcctgacctcaggctgtgtgaggtgttggcactgtagagaggttccacgacttttcctcatatgcctgcgttaattctgatgcacccagtcaaaagctga

SEQ ID NO: 452905 - DNA, 3778 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttggtaaggtgtggatgatgctaaccccccagggagcaggccccctccttggcttcattggctcccagggagtccccagtgagagtctgggaagatgacaacacacggggtgctggggtccctgccttgtcagaagctgtggggtatgaggggtctctagttgcatgttctgccttctgagagggagtgccagagggccagcaagaggttgggtggctggctgactcagggactccttcctgctgtgtgtttagattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttgtaagtagtcaccaactgccatacacccattatttactctgttcatccagccttccctccattcagcatttattcgttgggtacttgctgtgtgccactgagttaggtgcctgggctataggatgaaaaacaagtaagcaattagaatgatgtttttaagtgctatgattgaggaggcatcaggtgttagagggctggagtggagtgaaacgtcaaggaagactttcttgag

SEQ ID NO: 452906 - DNA, 1836 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttggtaaggtgtggatgatgctaaccccccagggagcaggccccctccttggcttcattggctcccagggagtccccagtgagagtctgggaagatgacaacacacggggtgctggggtccctgccttgtcagaagctgtggggtatgaggggtctctagttgcatgttctgccttctgagagggagtgccagagggccagcaagaggttgggtggctggctgactcagggactccttcctgctgtgtgtttagattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452907 - DNA, 684 bp, Homo sapiens
catgctgctgcattccagcctgggcaaaagagcgagaccttgtctcaaaaacaaaacaaaaagcagccatagacagtaagtaaatgaatgaatgcagctgtgttccagcaaaacctgatttacaaaaacaggcagtgggctagtttggcctgtgggccatagcttgccaacccctggtttagaacataacaagagtctttctatgctgtggtgtagcatatcggtaagagtgtaaatctgaagctacaatactaggttcaaatcccagctttactacgtatcagctctttctctgtggcttcattttcttatttgtaaaatgggggtattagtagtatacattgtaagactgtcataagaaataagttcatgtgtgtaatgcacttagcacagtgcctgacacatggtaaacagtaagcgttaatgatgatgaagataatttgttgtctttgccttttcatcagacatgtttgaaggagtcagatggcagtgatactgaggattttggctctgatcacagtgaagactgcctttcagaagcaagctgggaacctgttgataagaaagagactgaggtatgtttaggcacatatgtggtgggtacttacgtgagccagtgagtcatcatattttccagagatgaatgacatgctgtagactgagctgtcccccagaggagtgtca

SEQ ID NO: 452908 - DNA, 5945 bp, Homo sapiens
cgctccattgtggagaggaggggagaggcgcgcgggagccgcgcggaggcccggccaccagcgccctagcctcttggccgccgcggctgcacctggcgagccccgcagccgggatgcggcgggcgcccggggctggcgggcagcgcagcggctccggggacatgtgcgctggcccagaccgcccgcgaccatgagcctgaccgcccgcgtctcctgctccatgcttagctgcttcggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452909 - DNA, 5740 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgtttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452910 - DNA, 6049 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttggtaaggtgtggatgatgctaaccccccagggagcaggccccctccttggcttcattggctcccagggagtccccagtgagagtctgggaagatgacaacacacggggtgctggggtccctgccttgtcagaagctgtggggtatgaggggtctctagttgcatgttctgccttctgagagggagtgccagagggccagcaagaggttgggtggctggctgactcagggactccttcctgctgtgtgtttagattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452911 - DNA, 4428 bp, Homo sapiens
atttattatcatcattgtataaagggagaaaccaagtatctgagaggttaatttacttatttgtagtcatgtagctaattagcgtcagagccaatattgtctagctccaaaacccatcttctttctgttttactgtgatggaggcagtgggatattgggtttgagtctcaggtatagtcctagctggaacagtagattcagaaggcattggcatagaaggcagctgaaaccactgtagtggttgagattgcccagggagactggtaggttgagtgctgacaaaagctgaggatagatttttgggttccggaggacacggtccatgtctcatgctttttttacagagtaaactttcagtgaacattggttatttgtgatcttaagggtccttatttctaaacttaagtgttcttaagtgtcattatttctaaactctggctttgatattgctccattgattcagttccatatattgtattgcaagtgcccatctcctgacctggaggtgttatatttgtctttccagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452912 - DNA, 5224 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgttttgtttttgttttttttcatcttaatatgtaccagtggcacttaaccaaaagatacagtgatatagccatatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452913 - DNA, 4963 bp, Homo sapiens
  misc_feature (4629)..(4629): n is a, c, g, or t
  misc_feature (4633)..(4633): n is a, c, g, or t
  misc_feature (4645)..(4645): n is a, c, g, or t
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgaaaaaaaaanaaanaaaaaaaaaaanaaaaaaaaaaaaaaaaaaaaaaataaaaaaaaaaaaaaaaaaaaaaaaaaaaaatagtggtgggcggcccgcgccgccggccacacgaggaaaaaattttaacaaaccacctggggtggggggcgaggcgcgaccccaatgatgatatgaaacaaggtgtggaacaagacgtgtcccagagaagaaatcggcggcagacaggggggtggctccccccaaaaaaaagacggcggggacacgagggtgtgaacaccacaaggacatgtggaggcaagggggacaacagagagccacgaagcgagaaaataaccgcgccgg

SEQ ID NO: 452914 - DNA, 2855 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttggtaaggtgtggatgatgctaaccccccagggagcaggccccctccttggcttcattggctcccagggagtccccagtgagagtctgggaagatgacaacacacggggtgctggggtccctgccttgtcagaagctgtggggtatgaggggtctctagttgcatgttctgccttctgagagggagtgccagagggccagcaagaggttgggtggctggctgactcagggactccttcctgctgtgtgtttagattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 452915 - DNA, 602 bp, Homo sapiens
gcgagtaacgggatagcgcggctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgagaacaacggagcctcactcaggtcccctggccctagtcttgtccagttctctgtgctgcagggtttctctggtgcaagagaggaaagatcctgcctcactttccccagttggaagaaaaggtgaagaccatgttctgggttgggaggtcagtttactgacccataggatcttgacctgaaaaaatgggggtaatgcctagttcatggagtcatcgtaagg

SEQ ID NO: 452916 - DNA, 424 bp, Homo sapiens
ggtgggcccctgagccaagcaaactccctaaagctggcggtctgggagggagggcctgggacccccactgcccgcccctccaggctagagtgtgtggtgcttttcttataactaacactgcctttctctgcccatttccctcaaaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcata

SEQ ID NO: 452917 - DNA, 589 bp, Homo sapiens
tgcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcagaactagcggaattactggaggaagagagagagagactggagttgaagttaaggctcatttcaaggtttttagcctcaacatgtgcaggaatggagtcgtcacttgctagaatggg

SEQ ID NO: 452918 - DNA, 3882 bp, Homo sapiens
tgcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggcttttttttcctctcaaaaaaaaaaaaagaaaaagaaaaagaggaagaagcagctttgctgagttcatttatttactgacccgtcccttgcattccctccatggttttgaaaccacagacagtgtttgctggtgctgtcagtgatttttaccgtcactagcccagccaggcttcagtctgtccgacaggaagctgctgggtgggggtggggggagaaaaggcagataattaaaccatctcatcgtcttgcaggtcggagactacgtatgtaatcctcactctttggacagaaaaaaaaaaaaagtctttcttgcagacaagtcactacagaaacataccccatcccacccacccctgcctctgccccagccagccacacagagaagcaaattcttatgacttttgactgtaatgacatctggaatgtaaggagaggtgggaggtttaattccagaaaaattacaaggtccttaaaaagctctcacatcgagggctcaggctagcgtaaacaggctttctccagctcagtggagcagtgagcagccgactctgagattagctggcttctccacggccatcctatagacaggatttctaaagctcaaagaattctgtgtttaaacgatcacaataggccgctgctatcagattttagaaataaatgcagctttaccatgaacctgctccactgagaaaagccaggcagatcgatttttagatcaatttttacagtgctggcaacttggtggtgtgggatgctcctggatggagagggtttgctgctggggaggacatgggtgtgtgtgtgactgcaggggtcgtgtccaaggaatcaagagtcaccccagctgctgggctcctctgcctctctgcagcagaatgtccgtcctctgttgattgattggagaggaatagcagaacatttctcctgcccctcgttgcaaaacgagcttgtttccctgaacctcagaaatcctcagcttcaaacatggggaaacaggccagagcattgcccggctcctgaattaaactctgttctggtgcctgagctcaggggttttcagagaatgaataagagactgtccagtgactggtgggtccctgggggccagctgccttctcatcctgggaggtggcccttcccaagcccatcagggcgtgtgagcagactgaaggggccgctgcagcccctggccctcaatacccagctgcttctggctaagagtgcagcagagactgaggcatagccagcttcaaaagcgatctgacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatatgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaggaa

SEQ ID NO: 452919 - DNA, 3499 bp, Homo sapiens
ttagccttagctatgtgctccgagggtcgtggggagtcctcgcaatatcaatcgccagtgcagacagataagcattgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggcttttttttcctctcaaaaaaaaaaaaagaaaaagaaaaagaggaagaagcagctttgctgagttcatttatttactgacccgtcccttgcattccctccatggttttgaaaccacagacagtgtttgctggtgctgtcagtgatttttaccgtcactagcccagccaggcttcagtctgtccgacaggaagctgctgggtgggggtggggggagaaaaggcagataattaaaccatctcatcgtcttgcaggtcggagactacgtatgtaatcctcactctttggacagaaaaaaaaaaaaagtctttcttgcagacaagtcactacagaaacataccccatcccacccacccctgcctctgccccagccagccacacagagaagcaaattcttatgacttttgactgtaatgacatctggaatgtaaggagaggtgggaggtttaattccagaaaaattacaaggtccttaaaaagctctcacatcgagggctcaggctagcgtaaacaggctttctccagctcagtggagcagtgagcagccgactctgagattagctggcttctccacggccatcctatagacaggatttctaaagctcaaagaattctgtgtttaaacgatcacaataggccgctgctatcagattttagaaataaatgcagctttaccatgaacctgctccactgagaaaagccaggcagatcgatttttagatcaatttttacagtgctggcaacttggtggtgtgggatgctcctggatggagagggtttgctgctggggaggacatgggtgtgtgtgtgactgcaggggtcgtgtccaaggaatcaagagtcaccccagctgctgggctcctctgcctctctgcagcagaatgtccgtcctctgttgattgattggagaggaatagcagaacatttctcctgcccctcgttgcaaaacgagcttgtttccctgaacctcagaaatcctcagcttcaaacatggggaaacaggccagagcattgcccggctcctgaattaaactctgttctggtgcctgagctcaggggttttcagagaatgaataagagactgtccagtgactggtgggtccctgggggccagctgccttctcatcctgggaggtggcccttcccaagcccatcagggcgtgtgagcagactgaaggggccgctgcagcccctggccctcaatacccagctgcttctggctaagagtgcagcagagactgaggcatagccagcttcaaaagcgatctgacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatatgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaggaa

SEQ ID NO: 452920 - DNA, 3368 bp, Homo sapiens
ggtgggcccctgagccaagcaaactccctaaagctggcggtctgggagggagggcctgggacccccactgcccgcccctccaggctagagtgtgtggtgcttttcttataactaacactgcctttctctgcccatttccctcaaaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggcttttttttcctctcaaaaaaaaaaaaagaaaaagaaaaagaggaagaagcagctttgctgagttcatttatttactgacccgtcccttgcattccctccatggttttgaaaccacagacagtgtttgctggtgctgtcagtgatttttaccgtcactagcccagccaggcttcagtctgtccgacaggaagctgctgggtgggggtggggggagaaaaggcagataattaaaccatctcatcgtcttgcaggtcggagactacgtatgtaatcctcactctttggacagaaaaaaaaaaaaagtctttcttgcagacaagtcactacagaaacataccccatcccacccacccctgcctctgccccagccagccacacagagaagcaaattcttatgacttttgactgtaatgacatctggaatgtaaggagaggtgggaggtttaattccagaaaaattacaaggtccttaaaaagctctcacatcgagggctcaggctagcgtaaacaggctttctccagctcagtggagcagtgagcagccgactctgagattagctggcttctccacggccatcctatagacaggatttctaaagctcaaagaattctgtgtttaaacgatcacaataggccgctgctatcagattttagaaataaatgcagctttaccatgaacctgctccactgagaaaagccaggcagatcgatttttagatcaatttttacagtgctggcaacttggtggtgtgggatgctcctggatggagagggtttgctgctggggaggacatgggtgtgtgtgtgactgcaggggtcgtgtccaaggaatcaagagtcaccccagctgctgggctcctctgcctctctgcagcagaatgtccgtcctctgttgattgattggagaggaatagcagaacatttctcctgcccctcgttgcaaaacgagcttgtttccctgaacctcagaaatcctcagcttcaaacatggggaaacaggccagagcattgcccggctcctgaattaaactctgttctggtgcctgagctcaggggttttcagagaatgaataagagactgtccagtgactggtgggtccctgggggccagctgccttctcatcctgggaggtggcccttcccaagcccatcagggcgtgtgagcagactgaaggggccgctgcagcccctggccctcaatacccagctgcttctggctaagagtgcagcagagactgaggcatagccagcttcaaaagcgatctgacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatatgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaggaa

SEQ ID NO: 452921 - DNA, 887 bp, Homo sapiens
tgcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttgaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcata

SEQ ID NO: 452922 - DNA, 516 bp, Homo sapiens
acggagaaaacaagcgccgcaaaagaagtgaactatacagcagtcattaagaaaaggaagagcacaatcattcacccaccaaccgtctcaattctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaggaa

SEQ ID NO: 452923 - DNA, 938 bp, Homo sapiens
tgcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcata

SEQ ID NO: 452924 - DNA, 999 bp, Homo sapiens
  misc_feature (658)..(658): n is a, c, g, or t
tgcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaattttgcgcaagttgaaaagtgcaccagaccaggaggtgagatgtatttgcgtcctagggctaagtgattattagctaggtcgaaatgaaccagcttcgtactgaagtcaatcatagtcttggtgtatgacaacgtggccgcggaggacactcttacttgtagtatatacagtgctggacggaagtgttagtagactgagtgactgtgggaaaaaagagctatatgaaagatagattgctagaattgattacatgaaatatagatgctatatcgaaacattggataagaatattattcaacgagcgcagtaaaggagaaagtaaatttaattcgatcatgttagttgtgcgttattctgatgagtatggattacggctatctgtaagctaatcaagatgaatctatgaaaaagaaaggatgctggccagaaaaatgcgcaaagctataatcgaaagcgtgaaatgggggtgaatatggcactgnggagtcccagccgactataaaaagaggggaataatcataaccagcggatgcattcgcaagcatggacaacaatgccaaacttagcgcaagacacgcattgagagacttaacatggggatgaaatggcgggaatgtcaacaaggaaattagaaagctattggaatgagttaaatttcgatagtcgattattgagatacctgggatctcaatggagagcccgaaattccctcctggaaggttcgacgagggggaactaatctatcataagcgggatttaacgaacctggagaagcggtaccatcgggaaagtgaggaaaacagcccgaatataaggagacccg

SEQ ID NO: 452925 - DNA, 3749 bp, Homo sapiens
gtaatctgtctcctttgtggttgttgaagggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggcttttttttcctctcaaaaaaaaaaaaagaaaaagaaaaagaggaagaagcagctttgctgagttcatttatttactgacccgtcccttgcattccctccatggttttgaaaccacagacagtgtttgctggtgctgtcagtgatttttaccgtcactagcccagccaggcttcagtctgtccgacaggaagctgctgggtgggggtggggggagaaaaggcagataattaaaccatctcatcgtcttgcaggtcggagactacgtatgtaatcctcactctttggacagaaaaaaaaaaaaagtctttcttgcagacaagtcactacagaaacataccccatcccacccacccctgcctctgccccagccagccacacagagaagcaaattcttatgacttttgactgtaatgacatctggaatgtaaggagaggtgggaggtttaattccagaaaaattacaaggtccttaaaaagctctcacatcgagggctcaggctagcgtaaacaggctttctccagctcagtggagcagtgagcagccgactctgagattagctggcttctccacggccatcctatagacaggatttctaaagctcaaagaattctgtgtttaaacgatcacaataggccgctgctatcagattttagaaataaatgcagctttaccatgaacctgctccactgagaaaagccaggcagatcgatttttagatcaatttttacagtgctggcaacttggtggtgtgggatgctcctggatggagagggtttgctgctggggaggacatgggtgtgtgtgtgactgcaggggtcgtgtccaaggaatcaagagtcaccccagctgctgggctcctctgcctctctgcagcagaatgtccgtcctctgttgattgattggagaggaatagcagaacatttctcctgcccctcgttgcaaaacgagcttgtttccctgaacctcagaaatcctcagcttcaaacatggggaaacaggccagagcattgcccggctcctgaattaaactctgttctggtgcctgagctcaggggttttcagagaatgaataagagactgtccagtgactggtgggtccctgggggccagctgccttctcatcctgggaggtggcccttcccaagcccatcagggcgtgtgagcagactgaaggggccgctgcagcccctggccctcaatacccagctgcttctggctaagagtgcagcagagactgaggcatagccagcttcaaaagcgatctgacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatatgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaggaa

SEQ ID NO: 452926 - DNA, 1701 bp, Homo sapiens
ccacctactgcaactgttcccataaactgggtgacagagtcagaaaactccccagctaaacacccgtaagacttcatacaacacaatactctatactgtgatgatcacagctgccaaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatttgcgtgttatatgtattatacactatattcctacaataaagtaagctagagaaaatgttatttagaaaatcataagaaagagaaaatatatttactattcattaaatggaagtgggtcagccaaaaaaacaaaaaaaagaacaccagaaaacaaacaacgtggtgtgcgggcggccgccgcgcgcccacggggaaaaaagttttcaaaaacccatctccgttggggggccgcgggccccacgtctggtgttacgtcgagaccgtgtcgtcactagcgtggtctcccaagagaaacctggggtcgtgacaacgtgtgcgtgggcttctctccaccaataaaaacagcgccgggcgcaaacggcagcgttctggaaccaactccgactgggctctggcggcatgacggcctcatcacggggggtccaagcgaggccatccaat

SEQ ID NO: 452927 - DNA, 1771 bp, Homo sapiens
tgctgttcagaggatcccgacactgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgtagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaa

SEQ ID NO: 452928 - DNA, 3080 bp, Homo sapiens
acacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgtagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaa

SEQ ID NO: 452929 - DNA, 3006 bp, Homo sapiens
ccacctactgcaactgttcccataaactgggtgacagagtcagaaaactccccagctaaacacccgtaagacttcatacaacacaatactctatactgtgatgatcacagctgccaaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgtagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaa

SEQ ID NO: 452930 - DNA, 4728 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgaccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452931 - DNA, 4201 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagcctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcaaaaggccccgtgatacaagaatcagctgaaccaagccagttggaagttccagccacagaagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452932 - DNA, 4300 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgaccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaagttcagcgccaggcctggctctgaacttaggatgggggaagaggagaggcacattcaaggaagagaatgccagatgagctagccttgaaagtgtgaacaaggcctgatgggagaatttcaaatatttgtctgggatgcagggtgcag

SEQ ID NO: 452933 - DNA, 4268 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcaaaaggccccgtgatacaagaatcagctgaaccaagccagttggaagttccagccacagaagagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452934 - DNA, 3473 bp, Homo sapiens
gaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaacctcgcatcagccatttgttagccaggtcactctgttctttgtctgtaaatgagattgatcgttgttcccactgagagtgtcagctccttcccatagagcaggcatgatgattgtactcacctctgacaccattgtgagtgccacattccttcccacgtccttgtcaccgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccacggtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcatggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccagctggttgatcagagtgaccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452935 - DNA, 3693 bp, Homo sapiens
  misc_feature (31)..(31): n is a, c, g, or t
  misc_feature (34)..(34): n is a, c, g, or t
  misc_feature (39)..(41): n is a, c, g, or t
  misc_feature (51)..(51): n is a, c, g, or t
  misc_feature (53)..(53): n is a, c, g, or t
  misc_feature (56)..(56): n is a, c, g, or t
ttacaacagctccagttacaacagctcattntantgggnnntcgaattaantntgntattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgaccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452936 - DNA, 3089 bp, Homo sapiens
gaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaacctcgcatcagccatttgttagccaggtcactctgttctttgtctgtaaatgagattgatcgttgttcccactgagagtgtcagctccttcccatagagcaggcatgatgattgtactcacctctgacaccattgtgagtgccacattccttcccacgtccttgtcaccgtaagagatgcccacctgagcaccaaccccaggttatcttcccctttgtcttccagccccccagaaacagctacgactcaacctacccaatcatttcatcatcagattgccactgtctctagttcaggtctcttgggactggcactcagaaatctcataataaatcctcttgaggcttctcatacactcgtcttcttccaatcttctttccctcaaaatctcatattttggttccacttcacccacggtcattctccatatcactcccaggagttaggcaaaaagccccttccgttcttccgtatgttaaacttagaatcactctgttccctgctctgcgtttctattttttgtttttcctccatttactagtagcttaacactttctaacagtgttcttattattgatacgtatctatctcttccataagcttataaggtcatggataatacttctcattgtagtacgtaaatgacgtgggctagatatgagttgaataaacagttatacctgtaaattcttacagagtgaaaataaattgttatactttacaatttgtttctctctttagaccatttccaggacttgtgattaataaccagctggttgatcagagtgagtcaaaaggccccgtgatacaagaatcagctgaaccaagccagttggaagttccagccacagaagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452937 - DNA, 2469 bp, Homo sapiens
caaatgtatgttaaaatgcttttccaagggaacaacacatccttacattatttaaaccaatctgcttcattttcagagctggttgatcagagtgaccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452938 - DNA, 1303 bp, Homo sapiens
  misc_feature (7)..(7): n is a, c, g, or t
  misc_feature (73)..(73): n is a, c, g, or t
agaaaanctaaagaactgaactatcacaggaatttttcttcactgcagaagctgagatgttccagccacagangaaataaaagagactgatggaagctctcagatcaagcaagaaccagaccccacgtggtagacctcttccctcctaggcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452939 - DNA, 3360 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcaaaaggccccgtgatacaagaatcagctgaaccaagccagttggaagttccagccacagaagaaataaaagagactgatggaagctctcagatcaagcaagaaccagaccccacgtggtagacctcttccctcctaggagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452940 - DNA, 1342 bp, Homo sapiens
gagtgtagctggtagtgccagtctgagcggaacctctggaggataatcccggatgctcagtatgagaggtccttgggatcttactggtcccagatagtagaagtcttcgagtataatgagcaaacctgagattaggtagtgtccaaaagagaaaactctgccatgacaaaaatactggtacaggtcaagacagcttttagctctcctgctcttgaatccatggagaaagcttgttagcctgtgatcagtaagccatgggagtcgtggaaatgttttctgcgggctggctgggcattgctggtggtgaagctggatgttggctgcctgaccgttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452941 - DNA, 1537 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaaccgtgaactagattgttctcctagcttgcctcctgtggatggcttagtaaaactaaacaactaaagcgtttgctagtccccgcaaaatagaccacgtaagtccgtggtgagataagttcaa

SEQ ID NO: 452942 - DNA, 1433 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggatggtcatggatccagagatctccaggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaatcttcaatggaacctttgtgaagctcaacaagcttcgatttaacatgctgaggatttgtagaagccatatattggcctgggggggtaccccattctgaaatcccgttacatgaacttatctaacaagacgtggtcttgggcaaattccatagaagcgaattggtttgacacgtaaacgcttgattggccaactcctgggaacaaccgggtcactgctggagcgatcgggcacaaactttagcggggacaccccccaaggcgaaaaccggtgcgccacaattttccccaa

SEQ ID NO: 452943 - DNA, 588 bp, Homo sapiens
gaggccaaggcaggcagatcacctgaggtcaggagttccagaccagcctggccaacatggtgaaatcccatctctacaaaaataaaacagttagctgggcatgatggcgggtgcctgtaatcccagctactcgggaggctgaggcaggatagtcgcttgaacccaggaggtggaggttgcaatgagccaagatcatgccactgcactccagcctggacgacagagtgagactccatcacaagaaaaaaagaactttgtcaacctctgtcttagggcgccttgtcacaggcttcgggtcagacggattcaacctcgcatcagccatttgttagccaggtcactctgttctttgtctgtaaatgagattgatcgttgttcccactgagagtgtcagctccttcccatagagcaggcatgatgattgtactcacctctgacaccattgtgagtgccacattccttcccacgtccttgtcaccgtaagagatgcccacctgagcaccaaccccaggttatcttcccctattctcaggctacaccctagaccaacctacgccaaatccatttcactatcatattcatcggcgt

SEQ ID NO: 452944 - DNA, 732 bp, Homo sapiens
aacggggtttcaccatgttggccaggctagtctcagacttctgacctcaagtgatctgccagccttggcctccaaagtgctcggattacaggcgcgagccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgc

SEQ ID NO: 452945 - DNA, 434 bp, Homo sapiens
aatgaaaatagtcacttatttactcttcataaaatggcttaccagtcatgggaaggaaaagtcagggtcttttgtccacaacactaggaattattgtgttacaggatgattctgtgaatgcctttagaaaaaaaaaccctgatcacatcacgaccgttttactagctgtgaggccaccactgtactggctactgtaacacttcttggttttctttctagacctgaactagttatttcctacttgcctcctgggatggctagtaaaataaacactaaaggtaagagactacgtgtactccgtatcctatttgagcgcattaagacactctttatccgcattccttaaatcatacggaatcggccaatatctctgtggggcttggagttgtttactttgctttctaaggtattttatttaatggaactatttttct

SEQ ID NO: 452946 - DNA, 3648 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcaaaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452947 - DNA, 4344 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcaaaaggccccgtgatacaagaatcagctgaaccaagccagttggaagttccagccacagaagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452948 - DNA, 4092 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgaccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctaggagggtaaatcagcttctgtgtcagggatgctgtgtggcgtccatctgaaccccctgcatacgcgtagctaatgtgatctccccactttcacataagatggtggccctgccttcagggaatgtgggagccaggtgggagccttcccggatatttaagctagaagattctacagggagattctccttggatcaatatatgtctctcagtcaaagatgtaaaagcacttttgccttaaaaagaatgttctgtttctaaatagagtcaacgttgtcctcctcattggaattcactatgagtcagaatcattagactgacttttttttttccatagtaatagtattttgcagagtctcacagagctgcagatcttttgttcatcttgcagagttaacaagtctgatcctgttagtccagatttcttaaatttggccaagttataataggagcagtagcttgagacccgaagtcaggaaactttgacaatggattttttttttttaatccagagacttgtactggaatttgccttaccctgtcagctcatggacttaaggtttcatcccgctttatgagtgcttctgaatccaagtcattgttacctgaatttgcaaattaagttgtgatattcgtgactgttaaattcctgtaattagattaacctctttgcttgcttgtttgttttctctcctattttagcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagcta

SEQ ID NO: 452949 - DNA, 3012 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcaaaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagcta

SEQ ID NO: 452950 - DNA, 4032 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgaccaccttgcccagccaagacttttttatcaggacaaaggattgtgcatttaaactatttcactagaactgggtggtggttttgctctctttcttctgggtgaattggatttgcaggttatgctgttgagtgatgacgcatagctgcttttgctccattttccccagatgacttggtaaattctccgtgaatgactctgctacataacctagataacctaagtgtgtcctttaaatgcatgtaagccagaagatgtatgttactttgaaaacataagtaacaaaattttgaatgtattgctaaagagatgtctctctgaagctcttttgatgtttggtgtcttgtccttcttattaaaccatatcttagtaaatagtttggtacgaatggatttatcactgagcaggtctgcaaaataattaatcggtaccgttttgtttctgttgatagaaataaaagagactgatggaagctctcagatcaagcaagaaccagaccccacgtggtagacctcttccctcctaggcttaaagtatcagtggttgagaagagcttttcggacctgttactacccccaagctgtgtaatatacttgtataacagaaataccttcctatacaaacctttttttcctacttttagatagaaatgtcctactttttcagcagttctgtgaattaaagagcagagtgactgtgggtctggaatggctggtgtacttgggaatgtactatcaggattttacagcaatgctgggaaatgacagggaaaatgacaggaatgaatctcaccagattttttatgtactcagcagagccttgagttacggtgtttattttccaatcaagtgaagatatctcctacttctcctactggaacatctcagcttctgcagtgaagaaaaattcctgtgatagttcagttctttagtttttctatttgaaaaaaaaaaatcatttaaatgatcctttgttcacggctctccttaatgactgagtgaacagttcctatctgtatatttgactaaaccttttcctaagctatctctcatggttcctatgtttttttatcataattaaaagcaaaaccatctggatcacctaacagtcagaggtcagtatctcagcgtgtgaattatagaggaaatacagagagaacctcttccacttttacttttcgtccaaataaaatgcatggtgtaccagaagttgaagatcgggttgaggattggggctagctcgatgacactaaggccccaacatcgcgggacctgctgtggcgcggattcttaggaacgctgttctagccggccccctctccaggggtcgccgtggccggcattatttcctagttcttcttgtaaccctgaggtgccagcgcggggagtgaggaggggtcagggggctaaggatgcaacctctgacgttctgcgccttcctaggagagtcttacatgtgttgagatttcacaagcaatgcgagttgtaaaataccagctctacaagaagctaggctctgtgacggcatagttttcagtagctttatcacaatattcacaatggagaattatatgacatggtagcagaaataggcccttttatgtgttgcttctattttacctcaaattgtagatatagggtaatcaataaaatccatccatgcctttcacacactaagtca

SEQ ID NO: 452951 - DNA, 3121 bp, Homo sapiens
agtggcaagttgtttgttacagcgaacaccagctgctccccgcgccgggcgccgcgcgccgctgctccgccgctcggcccctcggctgctgctccgccggcgctgcctccctcgccccgcggctcccccttgcaacttggcgggcctcctcccttttgtccggcccggcccggccgccgccgccccccgcgcccggcgccgagctcccgggtctccgggccggctgtcggtgccggcagggcgcggagggggcgggggccgcggctcgtccccccgcggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttctagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgagttcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccacgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaatcagctgaaccaagccagttggaagttccagccacagaagcaacataaacagcagactgatggcacgctctcagcatcaagtctaatgaacccaggaccccacagatggtaagaacttcttccctcctagggtaaactccagctacatgtgtcacgggaatgctcgtgctgcgtgtcccatcatcgaaacacccactgacaacaacagccagcaacgccataaacagtcgaatctacaacaccaaattccaccacgtaacagcactggatggccccatgcccataagcagcgggcacactgcaagagcgaagcccccaacagaagggacgaagcacacactagccacacgcgaactaagtacagacacagccaccaaggaaaacgcacacacgtaacaccggggaacccaacaaccaaccatagagaccaaccaaacaacacataattggctccaacccataccacgcatacaaccaacagcaagtcgacacacacaccaagcccacactcacaactaggccgcccacacaaaaacaaacacgcaaaacctagccaaacaaagcgacaaccaccacacaccctacagcaacgctacacaccagagagaactgccacacaaaccccaataaccacataaggagcaaacatacaccacccacacctacgaacagtacacagaacaacaacacagaaccgacaaacccagccgacaccaaaaacaagaaaaccaaaaaaagaaaaaaaacagcgacagcaccaagcaaacacacagcgcaaacacaaccacgaccagcaccaccagcgcagaaact

SEQ ID NO: 452952 - DNA, 4112 bp, Homo sapiens
  misc_feature (3)..(5): n is a, c, g, or t
  misc_feature (10)..(11): n is a, c, g, or t
  misc_feature (14)..(16): n is a, c, g, or t
gannncggcnncgnnnggcggcggcggcggcggcggcagctgcggcgggagaagatggtggcgctggaggcagcagcggctggagcggagctttattcccaggcttggcaccagcgctgtcactagcgccgcctgctcccgcgggcccgcggacccagctgtcaggcaagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctactccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagattctccgtctcctggcagctcctcccccttgggtgcagagtcatcaagcacatctcttcaccccagtgaccctgtggaagcgcccactaataaagagtcaagaaaaagcttggcttcattcccaacctacgttgaagttccgggaccctgcgaccccgaagacttgatcgatggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttagagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgctttttttttttttttttttcaataccagggaagtttcgtatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccattcggatatcacccttccctgctcccaccaccagtgagacaagctgaagattaggcacacagatcccctggaaacccacctctctggaaggtcccttccctggcaggtggtcaggcaggcgggggctgttcagcctcatcctgagagacctgtcctctctgtgctgaggtccagcccctccagcaccactttggcttatcgtatcctcctcctggacttcccctctctgccgaacacacatcccaggagtctgggaaggagggactgttcccaagaaggcaagctgcaggtgcaattgcgtcttgttttctggcccaaggcaagaccaactttcttctctgctcagggccactaggcggatgtgatattggaaaggccagaatagtacataaaccacaaaattaaggagacaatagcaacctcaagttatgcctcagaatccccagatgtggtccataaacaccctcttgctgccttgtgggcctgagagcatttttggctggtgtggaattgttccgtgttttcatcaggtgccgatgatagcggggatcctctgacagcctcccg

SEQ ID NO: 452953 - DNA, 4079 bp, Homo sapiens
  misc_feature (3)..(5): n is a, c, g, or t
  misc_feature (10)..(11): n is a, c, g, or t
  misc_feature (14)..(16): n is a, c, g, or t
gannncggcnncgnnnggcggcggcggcggcggcggcagctgcggcgggagaagatggtggcgctggaggcagcagcggctggagcggagctttattcccaggcttggcaccagcgctgtcactagcgccgcctgctcccgcgggcccgcggacccagctgtcaggcaagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctactccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagattctccgtctcctggcagctcctcccccttgggtgcagagtcatcaagcacatctcttcaccccagtgaccctgtggaagcgcccactaataaagagtcaagaaaaagcttggcttcattcccaacctacgttgaagttccgggaccctgcgaccccgaagacttgatcgatggaatcatttttgccgccaattaccttggctccactcagctgctctcagacaaaactccttccaaaaacgtgcgcatgatgcaggcccaggaagccgtaagcaggatcaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttagagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgctttttttttttttttttttcaataccagggaagtttcgtatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccattcggatatcacccttccctgctcccaccaccagtgagacaagctgaagattaggcacacagatcccctggaaacccacctctctggaaggtcccttccctggcaggtggtcaggcaggcgggggctgttcagcctcatcctgagagacctgtcctctctgtgctgaggtccagcccctccagcaccactttggcttatcgtatcctcctcctggacttcccctctctgccgaacacacatcccaggagtctgggaaggagggactgttcccaagaaggcaagctgcaggtgcaattgcgtcttgttttctggcccaaggcaagaccaactttcttctctgctcagggccactaggcggatgtgatattggaaaggccagaatagtacataaaccacaaaattaaggagacaatagcaacctcaagttatgcctcagaatccccagatgtggtccataaacaccctcttgctgccttgtgggcctgagagcatttttggctggtgtggaattgttccgtgttttcatcaggtgccgatgatagcggggatcctctgacagcctcccg

SEQ ID NO: 452954 - DNA, 4115 bp, Homo sapiens
  misc_feature (3)..(5): n is a, c, g, or t
  misc_feature (10)..(11): n is a, c, g, or t
  misc_feature (14)..(16): n is a, c, g, or t
gannncggcnncgnnnggcggcggcggcggcggcggcagctgcggcgggagaagatggtggcgctggaggcagcagcggctggagcggagctttattcccaggcttggcaccagcgctgtcactagcgccgcctgctcccgcgggcccgcggacccagctgtcaggcaagcccagtggagcaaaatgagagcgcagtgagccgggcccagcttctctcctagccgttccgactcccaccatgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgcaccgccgcgcgctgcccaaccacctgcacttccactcgctggagcacgaggaagccatgaatgcggcctactcaggctacgtctacacgcaccggctcttccaccgcggtgaggacgagccctactccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggggcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatggacggagattctccgtctcctggcagctcctcccccttgggtgcagagtcatcaagcacatctcttcaccccagtgaccctgtggaagcgcccactaataaagagtcaagaaaaagcttggcttcattcccaacctacgttgaagttccgggaccctgcgaccccgaagacttgatcgatggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttagagaatcagtcccgagtcaagctgaatatcgtgagatgtcctccggtgaccaccgtgttaatcagaagaccagaccttcgctaccagctcggtttcagcgtccagaatggaattatctgcagcctcatgcgagggggaatagctgagagaggaggcgtccgtgtggggcaccggatcattgaaatcaatggacagagcgtcgtggccaccccccacgagaagatcgtccacattctctccaatgctgttggggagattcatatgaagacaatgccagccgcgatgtacaggctgctgacggcccaggagcagcctgtttacatctgaccgcggccacacgcggtggcatgcatggaggactctcctcttcgtggttgtgtttctcgtgctgcatccctgtgtccactgagactttcccctctcgcgcccagcatttggttttacacaggaagagaagaatccacaaggacctctttactctctccgatttgctttttttttttttttttttcaataccagggaagtttcgtatgcactcccttgaggatggagagcagccagcacccacctggtactgacccaggaccatcctggagggctttctgggtgtgtccagggggtgggctgtcactgcttgagggagaatcctcccttcccaggaggtgcagacttcttaaaaggagctcgcggggcagcaaagcagctgattcagcagtgcctaaaacccagttgctgatccctgctctctgagtttatctgtgggaatgtggtagtacccagggccagcccacgtcattaaggttatgcactgcctgccatgtagttggggcaccatacattatttcttcccagaatctctgagccaaccttaaacctcttctattgctagttctaatttcaacgtatgtgtgttttctaatacgagccttctcaccccaggataaaaggggaaataactgccttgggcaaggacaccatagtgtcacagagagcttggcaattcatggggcatctgaagctttaccaggttgtcctcaagttatcaaccattagataaacacaggcaggtactgtctgcttctctctctctcacacacacacacacacacacagtcccattcggatatcacccttccctgctcccaccaccagtgagacaagctgaagattaggcacacagatcccctggaaacccacctctctggaaggtcccttccctggcaggtggtcaggcaggcgggggctgttcagcctcatcctgagagacctgtcctctctgtgctgaggtccagcccctccagcaccactttggcttatcgtatcctcctcctggacttcccctctctgccgaacacacatcccaggagtctgggaaggagggactgttcccaagaaggcaagctgcaggtgcaattgcgtcttgttttctggcccaaggcaagaccaactttcttctctgctcagggccactaggcggatgtgatattggaaaggccagaatagtacataaaccacaaaattaaggagacaatagcaacctcaagttatgcctcagaatccccagatgtggtccataaacaccctcttgctgccttgtgggcctgagagcatttttggctggtgtggaattgttccgtgttttcatcaggtgcctcatatttatgcttccgtctcagttcagtgtagat

SEQ ID NO: 452955 - DNA, 131 bp, Homo sapiens
ctctattataatcttatggaccaccgccgttatctgcagtccatcattaactgaaccatcattatgcagcctacgactgtacacatatatatgtatagacatatacacatatacatacacttacatatata

SEQ ID NO: 452956 - DNA, 402 bp, Homo sapiens
gtgcctggtggccattcacttaaaaaaaaaaaaaaacagaaataaacacaccgttgctccaagaggtacctcctgctctagttttttggacttggcagtgctccactctactgctaggtcaaaagaacagccagagaaaccccacattcaggctaagttgcaaatggaaaggagctccctgctttcatcattaaaaagcactctgttcatcttaatgcagcccaatggagttgctttagtagcagtggctctccgggcctgtgtgttctcatagttaaaaaaataaaataaaaagcagatgggccggccagccagcctgcagactgtcagcgatgcagctttctgagaagtcagggtggggcaggggagaagggaagaacacaggcacacacacagagacag

SEQ ID NO: 452957 - DNA, 788 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaagtaagtctatcacatcttttttactttgttctgagtttatttaaaaaaaaaaaaaagcttcaattttgaggtagatttatagagataattttaagattttgtagatttttaatttcttaagttctgaaataaaggcctacatgttctttcctatatcgtacaaataatgcattctctaagatagaacccctgagtttatatgtatgtctttggagataaatgccaagaggggagtgaaccaggtagcgtctgagcttccctgaagaagagggtacattagttaagatatgagtaactggtacctggcctctttggcactagtggagaaaatgtgggctaacataccctaggaatagcaaaggaccttcaaaacagatgagtaggttcgtggagaaggataataatagtacaagttgagcaccccaaatataaaatgctccaaaatccaatagtttttgagtgctg

SEQ ID NO: 452958 - DNA, 880 bp, Homo sapiens
ttctttttttttaatagaacattcacattaagccagaagcactcatttcttaagtcctggggacagttagcatgtatatagtacctgggaacctgttgtaactgactaaataatgacgctattcagtgctctgaaataatagacgttaaaactgagataacatactggattttttaattgtgaattgagaaaaactaaaatccaggagaaaataccaagtagagtgtagacaattttaaataaagaaaatacaaaatagtatttggtttatttgttaaaaatagatcttatactttacttttttttcttcagtcttagagtttgaaagagtctatcttgataatctccccagtgcatccatgtatgagcgcagttacatgcatagagatgttatcacccatgtggtatgcaccaagtaagtctatcacatcttttttactttgttctgagtttatttaaaaaaaaaaaaaagcttcaattttgaggtagatttatagagataattttaagattttgtagatttttaatttcttaagttctgaaataaaggcctacatgttctttcctatatcgtacaaataatgcattctctaagatagaacccctgagtttatatgtatgtctttggagataaatgccaagaggggagtgaaccaggtagcgtctgagcttccctgaagaagagggtacattagttaagatatgagtaactggtacctggcctctttggcactagtggagaaaatgtgggctaacataccctaggaatagcaaaggaccttcaaaacagatgagtaggttcgtggagaaggataataatagtacaagttgagcaccccaaatataaaatgctccaaaatccaatagtttttgagtgctg

SEQ ID NO: 452959 - DNA, 1148 bp, Homo sapiens
agcttgaaatactattttttagtgattggacttacgaagtctatttcatattgtttagaatccttcttaagaagtacaaacagttagtggctcttaatatgtattctgcttctatttaaattctcattgcatatatagatagatgggttgatatagatataggtatatgtatatagagtttttgttactaaatggtttatttcctagatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtaagctttaatatgaggtatgttttttaaaaatgtgtttgtgggggaccatttcctccatcatgggaacagtgggagtattgtttgttccaagaaaagtggaatggccccaaatgtctaaacttaaccaaatgttttgactggatttttctgtggtctcttggttgtttataatcttatgtagaaagtttccactcatgtttgtaaaagaaatggaaagaagatatgcatagtttcaagttgttgtgtgttttttttaacaagtttgtctgtcttttgcttattgatttaaattagcctggttcatgttaaatgttgccaaagattttaaccacagaattcagcattacttcctgctagacataaaatcaaaagttaaaatgcatgaaaccacagtaagccttttttgtgaaaacagtccatttggtcttagtacaaaatagctacaatcagatactctcactgaatgtaaatgaacagaacttaatattttaaggagaaaaaaatgtcctgtacatttccatgtataaacatatttatattgtagttcttggcaatacaaaatctttgaagttttgcagaacagttaacagacatggaattttaataagaataggttaaaactgtataaacaaatgattgattgtttttaatagaccttacttttttgaacagttttaggttcacagcaaaattaagaggaagatacagagattttccatataccctctgccccaacacatgcatagc

SEQ ID NO: 452960 - DNA, 570 bp, Homo sapiens
aacttacctttagggaagatcttccagttccctttggtctgaaagatgcagatatttaattaaacattatactatgcttctattttttttaacacactggaaataacttttaaaagctgctacatttttattgctgagaaattattgtacttctttttaaatatatgctaaaggggagcgtaaacttaaattctctttaatttgctcaaccagaggatataatttaaagaaattggggtttaccaagattttccatttgtcctccaacacagccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaa

SEQ ID NO: 452961 - DNA, 758 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaaggtagctgcagacatagtaccgggacgaattggagtgctgcgtccgctgagtaggagggttcaagccagatccgaagagggatgatgtgtggagttttgtgccctcagaacagagggccgtcctctcacttctggctactccatacttgcatgtcttaacgaaatagtgatttaagcgtagtacaacgtctttttgataatatctaacacttttgatcattgatttgttatgacagatgctaaaactaacattttcctattcttatgtgtttggctcctctcatttactccccacagcagccacatgaagttggaatttcgaactcttatttaggtatgcaaaagggtaccagttctctttaaggctttagttcaggagtggtgttaatgtattaatgtgttggggcgcgagaggaaggcggtgcttatttcgaatcatggtaggtaaagataatttcaactctgacacttccactaataaattttcgcatctagggaaaatgacgtaagcttcctagatcacagatttgttttcatcc

SEQ ID NO: 452962 - DNA, 774 bp, Homo sapiens
tatgtatatagtaccctctatgtattaggcactgttctccaaggacttaatatctattcgtttaatcttcacaactaccttcattgcaaggtatgtactgttatcatcatatatgagtgagggaagagaagaaatgaattcacatccccaaagtcgcagaactggaattcaaatccaaacaatctaaataatgaactgagcaacaaacaggtggcatgttaggccttactagaaggcataagtcgagagctaccacaaatgaaacaattattcttgttaaatgtttgcccaagaaaatttctaaccaaagaaattaaattccatttgaaatcaatgtgttcagtatgttatgtggatccttttcatattagacaatgtaaaaataatttaattgcctgacacatcctgtatgggaagtgattcctgaaataaggattctgatgtgaattcttacatttcttaagtacttcattagaaattctattgttcataaaatttttaccagatgaaaactttaattcgttgactcactttttactttcctccttgagtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtatgtataacaactgtttttattggcttatgtaattaaga

SEQ ID NO: 452963 - DNA, 422 bp, Homo sapiens
gtagtaagaaatacaatggactacgattcaagatacttgagtttcaatctcaactctgcctctactgatgatgtaacctaaaataaattatttcacttctgtgagcctatttccttgtctttagaatacaaagattagagtatatgaattcacaattttgagacaatttcccccacattttagtatctctgaaatcagaatacattagatttgatgaaatacagtataaggtaacctagctctattgctatgccataacacaaaattataaaaattacctagtttttgttttggaattaagcactaagtgatgaagaagggaaaaatgtaactaccatctgccaggcacatagttttatgtagtattcacagtacttctactatcagtatccccagttttcaataatagatgaagaaacagt

SEQ ID NO: 452964 - DNA, 2009 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaagagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaa

SEQ ID NO: 452965 - DNA, 2895 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaaaaaaaaaaagaaaacaaaaaaaaaaaaaacaaaacagaacacagagaaaaaaaaaaaacacaacacaaagaaaaaaagaacaacaaaaaaagaacaacaacaacaagaagggggcgcgcgcgcgcgccgcggcgcggccccctcgcccgcggccggcgccccaacccgagcgccgcagcgcccaccctcgatctatctgaagcaaaaagagaagaagggggcgccaccacagcaagcgcgacgagcgacattattatcataaaaagaagccagcggcgcagcgcgcgcgcagccgctgcctatacataacacacaaacagacgacagcgcgaggagagcaagaaacagcaggcacaagcaaggtgatccaaactcgctgtcgcggaacaacgacaccaccaccaaaaacacaagggaggagggagggagacgaaacaaaactaagtgtgagtgatagaacagaagagaacatctcctgtctcgatccattaaatatagtatatatcctcaaccagacacatacgcctcgcgagtgccggtatatttgagattagatagtcatgtaatgctagtgcgtgtgatatgctgagtcgcggagcgcggagtggttgagataaaaaactccgcggggccactaagtcactgcttgcagcgattgcggattagataagtagaaagatagtgtagttgacgtagtgcgactaataatggagagaaaagtatgtatattaagctagacatcagtgaacacacaagatactttatctctcatctacagctgagggcgattggctcaatgaggatatggataagacgaaggaagaggagtgggggggt

SEQ ID NO: 452966 - DNA, 2391 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaaggtagctgcagacatagtaccgggacgaattggagtgctgcgtccgctgagtaggagggttcaagccagatccgaagagggatgatgtgtggagttttgtgccctcagaacagagggccgtcctctcacttctggctactccatacttgcatgtcttaacgaaatagtgatttaagcgtagtacaacgtctttttgataatatctaacacttttgatcattgatttgttatgacagatgctaaaactaacattttcctattcttatgtgtttggctcctctcatttactccccacagcagccacatgaagttggaatttcgaactcttatttagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaa

SEQ ID NO: 452967 - DNA, 1361 bp, Homo sapiens
actttaagtgctcaaaacccatgtactcttcggccttgtttgctgatgtacttgggtacaagattctcttggttcgtccatttccagctcttagaagtattacatggtaatgaaccgtatgaaataattgcataattttcagttaatattattgagaaagcttcgtactctgagtgtgattgtcatttaaagttgaataaatttagatgtcatttctatgattaaggttttggccaagagtatgtcgctgtagcataacaatgcttttgtaagaaaatgacctttcccaggaacttaacctatactactacatgcagacctataatactatatggagtaaactaacttaagatattgggccaggtacagtggctcaggcctgtaatctcagcactttaggaggctgaggcaggaggatgtcttgagtccagaaagtcaagatcagcctaggcaatatagtgagaccttgtctcttaagaaaaaaacatatttttaaggtgctatggctgtattttttttgactgctaaatgaccttgaaattttaatactgtcaaactcaaatattagttaagcagtcatgttctaaagataactaagttgaacaataagaatatactacttacatgaccctccgtgcttgtcctgagattagagattatgaaaaaaaaaaaaacaactgtccttctgaaacattcagaagacatggaaaggaaacatcattaggaagcagaactgcaaagaaaactgttttaagatgctctgaataggtttcatatttgtaacatatgtcttaataggtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaa

SEQ ID NO: 452968 - DNA, 1440 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatggtatgtgtaagtactaggagattagacggtaatgttccttccagtttggtttgacttttctttgtt

SEQ ID NO: 452969 - DNA, 1264 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagctcttagagtttgatagagtctatcttgattatctccccagtgcatccatgtatgagcgcagttacatgcatagagatgttatcacccatgtggtatgcaccaaacaatggaaggtaatacagagaatattggttttgtggtgtggtagattgagagccactcgagcgatatggaccatgagaacacattttattattagctgccagtcatagatggacatgtcaagttgtggaactataaatagatacgacgggaatgaatttgctacaca

SEQ ID NO: 452970 - DNA, 1192 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcgtaagtgtaatttaaatttaaccgtactttacttttctaaaaatgctttattttatgccttttcttgaaagatcttttttctacagatagacatttagatagacttatttttttcttagcacattagagatattcaactgtttctgtcttgtagtgttgctctttgaaagtctcttctctaggggtttatgatgtgcgt

SEQ ID NO: 452971 - DNA, 625 bp, Homo sapiens
gcagaaataaaacttcaaagcgtacatatatcgaaaaggacaatgtaatgtttttgtgtactttctgttaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacggtaagtacagtatcattgtttataaactacagattgataggttatgatgtaagagagtgaactcagtagaagagctgcattattctgtattttctgcattatttatatcatctagcagaatacaaatatgaaaatgatcaagaatataaaattatgtgactaatcagtttagaattggtaaaacaatactgccactgtagtaagaaatacaatggactacgattcaagatacttgagtttcaatctcaactctgcctctactgatgatgtaacctaaaataaattatttcacttctgtgagcctatttccttgtctttagaatacaaagattagagtatatgaattcacaattttgagacaatttccccc

SEQ ID NO: 452972 - DNA, 2119 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaa

SEQ ID NO: 452973 - DNA, 840 bp, Homo sapiens
ctcaggccaagatttcgcgcccgacgcgtctgcacagcttccgctctgatgcatgcggcaatcacatcatgcgtcggtcgcgagaacgtaggttagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaagtaagtctatcacatcttttttactttgttctgagtttatttaaaaaaaaaaaaaagcttcaattttgaggtagatttatagagataattttaagattttgtagatttttaatttcttaagttctgaaataaaggcctacatgttctttcctatatcgtacaaataatgcattctctaagatagaacccctgagtttatatgtatgtctttggagataaatgccaagaggggagtgaaccaggtagcgtctgagcttccctgaagaagagggtacattagttaagatatgagtaactggtacctggcctctttggcactagtggagaaaatgtgggctaacataccctaggaatagcaaaggaccttcaaaacagatgagtaggttcgtggagaaggataataatagtacaagttgagcaccccaaatataaaatgctccaaaatccaatagtttttgagtgctg

SEQ ID NO: 452974 - DNA, 2058 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaa

SEQ ID NO: 452975 - DNA, 2038 bp, Homo sapiens
ctcgagaatcggtcttgtacttttttttcctctggattcctacccagatatggtgtttctaccgggaataatttccctcaactcttccactgaactgacttttggtcaacctttagcacttagctatcatcttctctgggaagcctgtgacttctccagtctggactggatttctgaagcactttgatcataactctgagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaa

SEQ ID NO: 452976 - DNA, 1296 bp, Homo sapiens
tatgtatatagtaccctctatgtattaggcactgttctccaaggacttaatatctattcgtttaatcttcacaactaccttcattgcaaggtatgtactgttatcatcatatatgagtgagggaagagaagaaatgaattcacatccccaaagtcgcagaactggaattcaaatccaaacaatctaaataatgaactgagcaacaaacaggtggcatgttaggccttactagaaggcataagtcgagagctaccacaaatgaaacaattattcttgttaaatgtttgcccaagaaaatttctaaccaaagaaattaaattccatttgaaatcaatgtgttcagtatgttatgtggatccttttcatattagacaatgtaaaaataatttaattgcctgacacatcctgtatgggaagtgattcctgaaataaggattctgatgtgaattcttacatttcttaagtacttcattagaaattctattgttcataaaatttttaccagatgaaaactttaattcgttgactcactttttactttcctccttgagtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtgccctaagacagtggaaaacttctgtgttcacagcagaaatggttattataatgggcatacatttcaccgtataattaagggctttatgattcagactggagatccaacaggtactggtatgggaggagaaagcatatggggaggagaatttgaagatgaatttcattcaacattacgacatgacaggccgtacacactcagcatggctaacgcgggatcaaatactaatggatcccagtttttcataacggtagtaccaacgccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattaa

SEQ ID NO: 452977 - DNA, 1934 bp, Homo sapiens
gccttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtatgcaccaaaacagattttattattactgccagtcatgatggacatgtcaagttctggaaaaaaatagaagagggaattgaatttgttaaacattttcgtagtcacctgggagttattgagagtattgcagttagctctgagggagcattgttctgttctgtgggtgatgataaagcaatgaaggtgtttgatgtagtgaactttgacatgatcaacatgctgaaacttggctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtaagctttaatatgaggtatgttttttaaaaatgtgtttgtgggggaccatttcctccatcatgggaacagtgggagtattgtttgttccaagaaaagtggaatggccccaaatgtctaaacttaaccaaatgttttgactggatttttctgtggtctcttggttgtttataatcttatgtagaaagtttccactcatgtttgtaaaagaaatggaaagaagatatgcatagtttcaagttgttgtgtgttttttttaacaagtttgtctgtcttttgcttattgatttaaattagcctggttcatgttaaatgttgccaaagattttaaccacagaattcagcattacttcctgctagacataaaatcaaaagttaaaatgcatgaaaccacagtaagccttttttgtgaaaacagtccatttggtcttagtacaaaatagctacaatcagatactctcactgaatgtaaatgaacagaacttaatattttaaggagaaaaaaatgtcctgtacatttccatgtataaacatatttatattgtagttcttggcaatacaaaatctttgaagttttgcagaacagttaacagacatggaattttaataagaataggttaaaactgtataaacaaatgattgattgtttttaatagaccttacttttttgaacagttttaggttcacagcaaaattaagaggaagatacagagattttccatataccctctgccccaacacatgcatagc

SEQ ID NO: 452978 - DNA, 622 bp, Homo sapiens
tgagaacagtatggaggaaaccgctccatgattcaattatctcccactgtgtacctcccacaacacatgggaattatgggagctataattcaaaatgaggtttggcgggggacagagccaaaccatattagccacaggaaagctgttgagccttgcagtgcctctgaggatccctggctgtggggtgggcccgggttctagtccaagggctcctgcgtgcaactctgcccagcttccgtggagggttattcttgtgtttaagatatgtgtgtgtgattctgatggcaccttcctgcctcgggccagctgtgtgctgacgggcactgccgctgcctaggtgttggttccggtgagcccagcaactttgtgactgatccttgtcctcctctgttccagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452979 - DNA, 624 bp, Homo sapiens
attgtttcacagactctaagtgaaatcatgttggacaatgggaagcttcagccacagaacaattctttttttattttcctccctgatgcatggaattaagttttcatcaatattgcttttctttccaacaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452980 - DNA, 916 bp, Homo sapiens
aacggctaggtacgaggctgggtggtgagtcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcccgagaccttccgacagtgggcaagtatgtcccctctccgggccatcccttgggacgcggtcttggggaccacctgctcctcggggttggtcccctgggatgctcccttgcccttggtgtgcccagccggagctcgggcccggtcctgtcgcgtctgtcccgcgcgtcctccatt

SEQ ID NO: 452981 - DNA, 807 bp, Homo sapiens
tgtaagggtggcgagactgtggaggacctggagctggcgggggtcagggtaggggggaggggcagggctcggggttcgggggcggggtgttcacggtgagaccaaaagtcaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggtgagtgcagtctcttcaccaagataagaacggagcagcttcgtgggccaagagggctggccaggagactacacagacttctattcctctcggcagcatgctaccaacgtcggaatcatgttcagggacaaggagaatgcgttgatgccaaattggtatgaactgggccaaatgtctgcataagttcaaagtctttcttttcatttccagcagcatatttgtctcaggagctgccaagttcttcttaaagtaaactggggaggaaaagcagttatgatgttgcaacctctggaagcagtggt

SEQ ID NO: 452982 - DNA, 1476 bp, Homo sapiens
cgggcgagactgtggaggacctggagctggcgggggtcagggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452983 - DNA, 1547 bp, Homo sapiens
tgtaagggtggcgagactgtggaggacctggagctggcgggggtcagggtaggggggaggggcagggctcggggttcgggggcggggtgttcacggtgagaccaaaagtcaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452984 - DNA, 1536 bp, Homo sapiens
ccacggattccgacttccccatccacaacctgccctacggcgtcttctcgaccagaggcgacccaagaccgaggataggtgtggccattgggaccagatcctggacctcagcatcatcaagcacctcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452985 - DNA, 1354 bp, Homo sapiens
tacgaggccgggggtgccgacagaggcgaccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452986 - DNA, 1472 bp, Homo sapiens
caaactcaaggaggaatgcgaggcggtggctcgtgcattcgtgtacttcatccggatggccgctgataccgagtttgacatacacgttaggcgagacctacggctgtattctcaatcagaatcgagccaagaacgatagataggtggtggcacatagggtaccaaatactgatactgaggatgatcaaccacttctcttgaaatgtgtcctgtcctctacaatggaccatgtgaatgttaactcattcactctacacgtctaccagctgcactggtccctgagtgttgcgtgtgtgctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452987 - DNA, 1811 bp, Homo sapiens
tgtaagggtggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgcaaaaaaaaaaaaaacaaaacaaagcacacacaaccaccgaaccaaccacacagccagaaaccgccgcgaggcactacacggcggccacacaatagggcgccaaagcgcgcgggcaacagagaccccacacacagccgagagaccg

SEQ ID NO: 452988 - DNA, 1772 bp, Homo sapiens
  misc_feature (1328)..(1328): n is a, c, g, or t
tgtaagggtggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggtgantatctggctgcactgagggctgcccacgcagagcatccctgctccccacacagccccaagggccctcagctcagcctcgagaagagatttcaggcccgaggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452989 - DNA, 1565 bp, Homo sapiens
tgtaagggtggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaaggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452990 - DNA, 803 bp, Homo sapiens
  misc_feature (92)..(92): n is a, c, g, or t
cggccgccctcttaaaaacaatgaatccccccgggtttaagtatttgggccagaggcccataaaccaatttttgtgaatggtctcttatgancgcgtgaagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452991 - DNA, 853 bp, Homo sapiens
tgtaagggtggcgagactgtggaggacctggagctggcgggggtcagggtaggggggaggggcagggctcggggttcgggggcggggtgttcacggtgagaccaaaagtcaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaggctccgttatgggctgggggccctggccttgcggcggaacgggttgtgtggcccggagcacgtgtgggcgcctcccttcaggccgggactttgtgggctttacgacggggcgcgcgcaaaggggggcctcgggcctgggagtggcgctccggcgg

SEQ ID NO: 452992 - DNA, 1667 bp, Homo sapiens
tgtaagggtggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452993 - DNA, 1440 bp, Homo sapiens
aacggctaggtacgaggctgggtggtgagtcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452994 - DNA, 1366 bp, Homo sapiens
cgggcgagactgtggaggacctggagctggcgggggtcaggccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452995 - DNA, 1634 bp, Homo sapiens
tgtaagggtggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452996 - DNA, 1518 bp, Homo sapiens
  misc_feature (1493)..(1493): n is a, c, g, or t
  misc_feature (1500)..(1500): n is a, c, g, or t
  misc_feature (1508)..(1508): n is a, c, g, or t
tgtaagggtggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggggnttaagcncccctttncctgtgactg

SEQ ID NO: 452997 - DNA, 894 bp, Homo sapiens
gtggctgtctagaggatccctcataggttcgcaggatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgca

SEQ ID NO: 452998 - DNA, 1707 bp, Homo sapiens
tgtaagggtggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggtaagcacattctctgcaggaagctcccaaacccagccctgctgcctctgaggctgcttgcccactgagtggacatgccaggcatgcagaccatcaggagggaagctctgtgcccacggcatgcccacagcagagtgcctgggagttcctggccacgattacttccaggcagccagggcatcattctcccttgtggtttccctggccctggcacagttcttggagaaaacacagaattttgtaaccttaagaatcttgcaagacccgggggatctggccagttggcaggaggagtccctgcaggtaccaacattgcacaacctcccaggtggccatcaaatcttgttctgtgcaaatggcgccacctggaccccaactcatagaatgcagcttggagcccagcaacagggagtccctgcagcctctggttcccggcaccgcttggtctaccactgggtctaggccttgacccctggttccagtcctcccttctcagcctgttgcaatctgccccactccatcactggcaacacctggccagagtcacctgtgacccgatagtcagtgtcatgaccttgtgtccccttcagcatggacttcctgtggccc

SEQ ID NO: 452999 - DNA, 2925 bp, Homo sapiens
  misc_feature (3)..(3): n is a, c, g, or t
  misc_feature (154)..(154): n is a, c, g, or t
  misc_feature (168)..(168): n is a, c, g, or t
  misc_feature (216)..(216): n is a, c, g, or t
  misc_feature (230)..(230): n is a, c, g, or t
  misc_feature (286)..(286): n is a, c, g, or t
  misc_feature (451)..(451): n is a, c, g, or t
  misc_feature (558)..(558): n is a, c, g, or t
  misc_feature (594)..(594): n is a, c, g, or t
  misc_feature (670)..(670): n is a, c, g, or t
  misc_feature (676)..(676): n is a, c, g, or t
  misc_feature (682)..(682): n is a, c, g, or t
  misc_feature (699)..(699): n is a, c, g, or t
  misc_feature (2227)..(2227): n is a, c, g, or t
  misc_feature (2543)..(2543): n is a, c, g, or t
ggncactctgcagacagctccagacaatcaggcactcgtcacacagagtcttcctctcgtggacaggctgcgtcatcccatgaacaggcaagatcaagtgcaggagaaagacatggatcccaccaccagcagtcagcagacagctccagacacncaggcattgggcanggacaagcttcatctgcagtcagagacagtggacaccgagggtacagnggtagtcaggccantgacagtgagggacattcagaagactcagacacacagtcagtgtcagcacaggganaagctgggccccatcagcagagccacaaagagtccgcacgtggccagtcaggggaaagctctggacgttcagggtctttcctctaccaggtgagcactcatgaacagtctgagtccacccatggacagtctgcgcccagcactggaggaagacaaggatcccacnatgatcaggcacaagacagctccaggcactcagcatcccaagagggtcaggacaccattcgtggacacccggggccaagcagaggaggaagacaggggtcccaccangagcaatcggtagataggtctggacactcagggtcncatcacagccacaccacatcccagggaaggtctgatgcctcccgtgggcagtcaggatccagaagtgcaagcaganaaacanatgacnaggaacaatcaggaganggctctaggcactcagggtcgcatcatcatgaagcttccactcaggcggacagctctagacactcacagtccggccagggacaatcagcggggcccaggacaagcaggaaccagggatccagtgttagccaggacagtgacagtcagggacactcagaagactctgagaggtggtctgggtctgcttccagaaaccatcgtggatctgctcaggagcagtcaagagatggctccagacaccccaggtcccatcacgaagacagagccggtcacgggcactctgcagagagctccagacaatcaggcactcatcatgcagagaattcctctggtggacaggctgcatcatcccatgaacaggcaagatcaagtgcaggagagagacatggatcccaccaccagcagtcagcagacagctccagacactcaggcattgggcacggacaagcttcatctgcagtcagagacagtggacaccgagggtccagtggtagtcaggccagtgacagtgagggacattcagaagactcagacacacagtcagtgtcagcccacggacaggctgggccccatcagcagagccaccaagagtccacacgtggccggtcagcaggaaggtctggacgttcagggtctttcctctaccaggtgagcactcatgaacagtctgagtctgcccatggacgggctgggcccagtactggaggaagacaaggatcccgccacgagcaggcacgagacagctccaggcactcagcgtcccaagagggtcaggacaccattcgtggacacccggggtcaaggagaggaggaagacagggatcctaccacgagcaatcggtagataggtctggacactcagggtcccatcacagccacaccacatcccagggaaggtctgatgcctcccatgggcagtcaggatccagaagtgcaagcagagaaacacgtaatgaggaacagtcaggagacggctccaggcactcagggtcgcgtcaccatgaagcttccactcaggctgacagctctagacactcacagtccggccagggtgaatcagcggggtccaggagaagcaggcgccagggatccagtgttagccaggacagtgacagtgaggcatacccagaggactctgagaggcgatctgagtctgcttccagaaaccatcatggatcttctcgggagcagtcaagagatggctccagacaccccggatcctctcaccgcgatacagccagtcatgtacagtcttcacctgtacagtcagactctagtaccgctaaggaacatggtcactttagtagtctttcacaagattctgcgtatcactcaggaatacagtcacgtggcagtcctcacagttctagttcttatcattatcaatctgagggcactgaaaggcaaaaaggtcaatcaggtttagtttggagacatggcagctatggtagtgcagattatgattatggtgaatccgggtttagacactctcagcacggaagtgttagttacaattccaatcctgttnttttcaaggaaagatctgatatctgtaaagcaagtgcgtttggtaaagatcatccaaggtattatgcaacgtatattaataaggacccaggtttatgtggccattctagtgatatatcgaaacaactgggatttagtcagtcacagagatactattactatgagtaagaaattaatggcaaaggaattaatccaagaatagaagaatgaagcaagttcactttcaatcaagaaacttcataatactttcagggaagttatcttttcctgtcaatctgtttaaaatatgctatagtatttcattagtttggtggtancttatttttattgtgtaatgatctttaaacgctatatttcagaaatattaaatggaagaaatcaatatcatggagagctaactttagaaaactagctggagtattttaggagattctgggtcaagtaatgttttatgtttttgaaagtttaagttttagacactccccaaatttctaaattaatctttttcagaaatatcgaaggagccaaaaatataaaacagttctgataccaaagtggctatatcaacatcagggctagcacatctttctctattatccttctattggaattctagtattctgtattcaaaaaatcatcttggacataattaatattttagtaagctgcatctaaattaaaaataaactattcatcata

SEQ ID NO: 453000 - DNA, 288 bp, Homo sapiens
gtctccctatgagcaactgtggctccgagaggtgataggttgtgacgtgcccgatggggttccagccgctttccacctgcagccctgcagctgcctcccctcaggtttgctggtgctcgaagcaaggactggcttgacttctgtcctgagaaaggtggactgggttctgttctgatgtatagtttacaaatcgtgaaactccagcatagagtgcatataatcatgttcacacccatgcaaccaccttctccctccaagatgcaggacaattctctcaccccctcccag

SEQ ID NO: 453001 - DNA, 2677 bp, Homo sapiens
actcactatagggctcgagcggccgcccgggcaggcgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453002 - DNA, 2801 bp, Homo sapiens
tggctggcaatggccttgctgacctcgagccgggcccacgtggggacctttggagcacagcctacgatcctggtgcaaggccggtggatgcagaggccagtccatataccacccaggcctgcgaggagcgtggtccccacccatccagcccatatgtgcaagtgcccttgacagagaggctggtcatatccatggtgaccatttatgggccacaacaggtccccatctgcgcagtgaaccctgtgctgagcaccttgcagacgtgatcttgcttcgtcctgcagcactgtgcggggcaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453003 - DNA, 2751 bp, Homo sapiens
gaaggccggggcagcggaggcttccggcggccggtggatgcagaggccagtccatataccacccaggcctgcgaggagcgtggtccccacccatccagcccatatgtgcaagtgcccttgacagagaggctggtcatatccatggtgaccatttatgggccacaacaggtccccatctgcgcagtgaaccctgtgctgagcaccttgcagacgtgatcttgcttcgtcctgcagcactgtgcggggcaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453004 - DNA, 1834 bp, Homo sapiens
tggcgaattcggcacgaggatgtcatgtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453005 - DNA, 2331 bp, Homo sapiens
gtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453006 - DNA, 2201 bp, Homo sapiens
gtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcgcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453007 - DNA, 1205 bp, Homo sapiens
gtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgcctggtggtgatggtgtttcttagagagaagatcactgaagaaacttctgctttaatggctttacaaagctggcaatattacaatccttgacctcagtgaaagcagtcaccttcagcgttttccagccctatagccaccccaagtgtggttatgcctcctcgattgctccgtactctaacatctagctggcttacctgtctag

SEQ ID NO: 453008 - DNA, 967 bp, Homo sapiens
gtctccctatgagcaactgtggctccgagaggtgataggttgtgacgtgcccgatggggttccagccgctttccacctgcagccctgcagctgcctcccctcaggtttgctggtgctcgaagcaaggactggcttgacttctgtcctgagaaaggtggactgggttctgttctgatgtatagtttacaaatcgtgaaactccagcatagagtgcatataatcatgttcacacccatgcaaccaccttgcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453009 - DNA, 603 bp, Homo sapiens
ggaacctgcattgttttgtaaaatcttcagaattcaggttttctgaaaaccctatgatggttccaccagtcccggtgtgggctgaatctgcttcctgagctgggtcctgctggctgggtcggaggagctaagagctggcatccccggctttctcgcctttgttctgctgggatgtggtagggagatcagctgtgcagctttgacgcctggctctggtaccaggatgggtgggagcccccaaccctcgctcctgggtgcagagcgtggttgtatctggggccggggcctctgaccccctgtccccgctgcagattgagatggccatcctgcggttcccttacgagtcctgggggaccccgttccagcagctgaagcaggtggtggaggagccgtccccccagctcccagccgaccgtttctcccccgagtttgtggacttcactgctcagtggtgagtcttgggtgctgctgagcgcctgccactgcccctccctggccagatccctgcaccttcctgggccctgttcctttattcctttggcaaataaacccccagatgacttggcatccaaatatgtaaggcagaaacagctggagcatgag

SEQ ID NO: 453010 - DNA, 2779 bp, Homo sapiens
gtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453011 - DNA, 2232 bp, Homo sapiens
cccaaattaatgacagcagatgctgaagtctgagatggtcagatgttaggaaggggattggctgtgaccacctgggacctgcccacctggctcatgaggctacggcccaaagttgccagctcctcagatttttccagagcagctggaacctgcattgttttgtaaaatcttcagaattcaggttttctgaaaaccctatgatggttccaccagtcccggtgtgggctgaatctgcttcctgagctgggtcctgctggctgggtcggaggagctaagagctggcatccccggctttctcgcctttgttctgctgggatgtggtagggagatcagctgtgcagctttgacgcctggctctggtaccaggatgggtgggagcccccaaccctcgctcctgggtgcagagcgtggttgtatctggggccggggcctctgaccccctgtccccgctgcagattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453012 - DNA, 2108 bp, Homo sapiens
gtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggatgggccaccgccttgcccagcctggatgccatccaagttgtatatttttttaatctctcgactgaatggactttgcacactttggcccagggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttctttttgggacagagtctcgctctgtcactcccaggctagagtgcagtgacacgttctcggcccaatgcaatctccgcctcctgggttcaagcaattctcctgcatcagcctcccgagcagctgggaccacaggcgcccaccaccacgcccagctaatttttctatttttagga

SEQ ID NO: 453013 - DNA, 1988 bp, Homo sapiens
gtctccccggcgctgcccagtctgtctccggcgccgcccgtcgcggactcgtccttgctgcagtcgccgccgcagtcctcgccgcagtcgccgccgccgccgccgccgccgccgctgctcctccgcctggcctgggccgtctgcccgcagccatgagcgtgctcggccccggtggagcccgcagtcctctagattagtctccaccgccgtccaggacccacttgcagcatggagtcgcccgcctcgagccagcccgccagcatgccccagtccaaaggaaaatccaagaggaagaaggatctacggatatcctgcatgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatgctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggctatgggtttgctttggtgttgtttttaaaaaaagaaaatatatttttttgaaaaaacgactgcccatcccgggtcctttccctgatgggttggggcagttacctggttgctgttttaattaaaaaaaaaaaaaaaaaaaaaacagaggcggggttccaccggggcctgctttccaacgtggccctcttataattaaagggaggctggtgtgggtaacgcagcaacttctttcacaacgacggggtcatcttggggagcccggggacccaccaatagtttgggggcttgtcacaccagccggcgctcttctccgggtaacactaacgacaccctttggggcgcccttatagggcaggggtggggtcgcgcgcccaaagaaaagggttccccgaggaattccccttcgtgggggggatctccccaccccgggggggccactctccgctggggaaatctcctgggcaacccccggggcgtggctggccaaccgggcaagtcgggggccaaggggaaacccttgacccacctcccgtgggagggaagcaagggggccgcacagagggcggagcgcgacacgggcggggtctccccccagtgtataccctaaggtggccccccagaaagaggggggtccggcaacaacc

SEQ ID NO: 453014 - DNA, 678 bp, Homo sapiens
gcggccgcctactactactaaattcgcggccgcgtcgacggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaaaaaaaatattctaattaattaaaaaaaaaacctcaggggggcccgggtcccaattcgcctataggggtcgtttacaattcctgccct

SEQ ID NO: 453015 - DNA, 446 bp, Homo sapiens
cgtctcctcctcctcctttgtcaacccaaactgcggtgacgctgcgctcagacctgccacagctccagcctcaccgcagtttgggttgacaagggaggatgggagtatgggctacagcaatcaaggggaagatttgagctcctggagcccagccccaagacgcagcgagtgtcctgttatacagggcaggtgctcacagttacacaggacgacagggtcaagaaattgctcaattgaacacctgctatttgtcgggccctgttctgggcagagggatgtagtggtaaatggggagcccactattccagtggagggagacacacagtaaagttgttggccaataaagagcacagataaagccaaatgccaataagtgcctggaagaaaatgagatagagtgcgctgtgggcaatggggctgggtggggtggaggtgaccagttaggg

SEQ ID NO: 453016 - DNA, 956 bp, Homo sapiens
  misc_feature (691)..(691): n is a, c, g, or t
  misc_feature (694)..(694): n is a, c, g, or t
  misc_feature (697)..(701): n is a, c, g, or t
  misc_feature (706)..(706): n is a, c, g, or t
  misc_feature (709)..(709): n is a, c, g, or t
  misc_feature (713)..(713): n is a, c, g, or t
  misc_feature (780)..(780): n is a, c, g, or t
gaaaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaaaaaaaaaaaaaaaaacaaaaaaaaaaaaaaaaaaaaaaaaaaaaaaaaaaaaaaaaaaaaaaaaaaaaaaaaaaaaaaaagggggggggggaaaaaaaatccccggggggcccaanttnggnnnnnccggnttntttntgacaagggggcccaaagaggggggcgtaataaaaggaagagcaggggcgcggttaaacagttgggngtgggaaaatggtcctgggattcggggagggacctaattgcggggggacatgggacataaaccagagttaaggtcaggaataaacttaggtgagggtgacaacgctatgtggcggaattgtcggtttataacagaaaaagaaaataggagataagaagagagttagaatggaaaaa

SEQ ID NO: 453017 - DNA, 972 bp, Homo sapiens
  misc_feature (707)..(707): n is a, c, g, or t
  misc_feature (710)..(710): n is a, c, g, or t
  misc_feature (713)..(717): n is a, c, g, or t
  misc_feature (722)..(722): n is a, c, g, or t
  misc_feature (725)..(725): n is a, c, g, or t
  misc_feature (729)..(729): n is a, c, g, or t
  misc_feature (796)..(796): n is a, c, g, or t
gcggccgcctactactactaaattcgcggccgcgtcgacggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaaaaaaaaaaaaaaaaacaaaaaaaaaaaaaaaaaaaaaaaaaaaaaaaaaaaaaaaaaaaaaaaaaaaaaaaaaaaaaaaagggggggggggaaaaaaaatccccggggggcccaanttnggnnnnnccggnttntttntgacaagggggcccaaagaggggggcgtaataaaaggaagagcaggggcgcggttaaacagttgggngtgggaaaatggtcctgggattcggggagggacctaattgcggggggacatgggacataaaccagagttaaggtcaggaataaacttaggtgagggtgacaacgctatgtggcggaattgtcggtttataacagaaaaagaaaataggagataagaagagagttagaatggaaaaa

SEQ ID NO: 453018 - DNA, 1036 bp, Homo sapiens
  misc_feature (771)..(771): n is a, c, g, or t
  misc_feature (774)..(774): n is a, c, g, or t
  misc_feature (777)..(781): n is a, c, g, or t
  misc_feature (786)..(786): n is a, c, g, or t
  misc_feature (789)..(789): n is a, c, g, or t
  misc_feature (793)..(793): n is a, c, g, or t
  misc_feature (860)..(860): n is a, c, g, or t
gccccatgcttctccggcgcacagcttctccaccatgtcgctgctgaggggaagctcttcctgctgtggtgctttagggcacccacccttgggcatcgtcctgctcctcacccgatcttcatttacacggccggcgcttcatcatcaaccgtctgcgattccatagctgaaagtcagtgctgacgaggactgtcttttaaatcccatggaggtgtgtcccagagcagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaaaaaaaaaaaaaaaaacaaaaaaaaaaaaaaaaaaaaaaaaaaaaaaaaaaaaaaaaaaaaaaaaaaaaaaaaaaaaaaaagggggggggggaaaaaaaatccccggggggcccaanttnggnnnnnccggnttntttntgacaagggggcccaaagaggggggcgtaataaaaggaagagcaggggcgcggttaaacagttgggngtgggaaaatggtcctgggattcggggagggacctaattgcggggggacatgggacataaaccagagttaaggtcaggaataaacttaggtgagggtgacaacgctatgtggcggaattgtcggtttataacagaaaaagaaaataggagataagaagagagttagaatggaaaaa

SEQ ID NO: 453019 - DNA, 593 bp, Homo sapiens
gaaaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggtcacacaacttctatataacttctgaacatctcttcagtacccttagtctcggaacatttggaacccgtcgatcggggtagaacagcgcaccgatccaagttgtatcgtgagaagaacgatgtttgtgaaaccgcatttttcccgcgcgctgaggcatacgctcgtgccggtgtgcgtggcggcgttcgtgctgagcgcctgtggcacccagaaggcgaccagccagtcgaccagcatgaaggtgacgcgcggcaccatatcgcagagcatcagcggcagcggccagatcgaggcgaa

SEQ ID NO: 453020 - DNA, 604 bp, Homo sapiens
gaaaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaaggtagggctggactctggcaggtctgacccagcctcaccgcagtttgggttgacaagggaggatgggagtatgggctacagcaatcaaggggaagatttgagctcctggagcccagccccaagacgcagcgagtgtcctgttatacagggcaggtgctcacagttacacaggacgacagggtcaagaaattgctcaattgaacacctgctatttgtcgggccctgttctgggcagagggatgtagtggtaaatggggagcccactattccagtggagggagacacacagtaaagttgttggccaataaagagcacagataaagccaaatgccaataagtgcctggaagaaaatgagatagagtgcgctgtgggcaatggggctgggtggggtggaggtgaccagttaggg

SEQ ID NO: 453021 - DNA, 524 bp, Homo sapiens
  misc_feature (259)..(259): n is a, c, g, or t
  misc_feature (262)..(262): n is a, c, g, or t
  misc_feature (265)..(269): n is a, c, g, or t
  misc_feature (274)..(274): n is a, c, g, or t
  misc_feature (277)..(277): n is a, c, g, or t
  misc_feature (281)..(281): n is a, c, g, or t
  misc_feature (348)..(348): n is a, c, g, or t
gcggccgcctactactactactactgctcgaattcaagcttctaacgatgtacggggtcatggtggccacggccacagccactaatcaggaggccaggccaccctgcctctacccaaccagggccccggggcctgttatgtcaaactgtcttggctgtggggctaggggctggggccaaataaagtctcttcctccaaaaaaaaaaaaaaaaaaaaaaaaaaagggggggggggaaaaaaaatccccggggggcccaanttnggnnnnnccggnttntttntgacaagggggcccaaagaggggggcgtaataaaaggaagagcaggggcgcggttaaacagttgggngtgggaaaatggtcctgggattcggggagggacctaattgcggggggacatgggacataaaccagagttaaggtcaggaataaacttaggtgagggtgacaacgctatgtggcggaattgtcggtttataacagaaaaagaaaataggagataagaagagagttagaatggaaaaa

SEQ ID NO: 453022 - DNA, 901 bp, Homo sapiens
  misc_feature (636)..(636): n is a, c, g, or t
  misc_feature (639)..(639): n is a, c, g, or t
  misc_feature (642)..(646): n is a, c, g, or t
  misc_feature (651)..(651): n is a, c, g, or t
  misc_feature (654)..(654): n is a, c, g, or t
  misc_feature (658)..(658): n is a, c, g, or t
  misc_feature (725)..(725): n is a, c, g, or t
gaaaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaaaaaaaaaaaaaaaaaaaaaaaaaaagggggggggggaaaaaaaatccccggggggcccaanttnggnnnnnccggnttntttntgacaagggggcccaaagaggggggcgtaataaaaggaagagcaggggcgcggttaaacagttgggngtgggaaaatggtcctgggattcggggagggacctaattgcggggggacatgggacataaaccagagttaaggtcaggaataaacttaggtgagggtgacaacgctatgtggcggaattgtcggtttataacagaaaaagaaaataggagataagaagagagttagaatggaaaaa

SEQ ID NO: 453023 - DNA, 926 bp, Homo sapiens
  misc_feature (661)..(661): n is a, c, g, or t
  misc_feature (664)..(664): n is a, c, g, or t
  misc_feature (667)..(671): n is a, c, g, or t
  misc_feature (676)..(676): n is a, c, g, or t
  misc_feature (679)..(679): n is a, c, g, or t
  misc_feature (683)..(683): n is a, c, g, or t
  misc_feature (750)..(750): n is a, c, g, or t
cgagaagagtgctaccgacaagccattggaaacggcgagaggcgaatacagagaaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaaaaaaaaaaaaaaaaacaaaaaaaaaaaaaaaaaaaaaaaaaaaaaaaaaaaaaaaaaaaaaaaaaaaaaaaaaaaaaaaagggggggggggaaaaaaaatccccggggggcccaanttnggnnnnnccggnttntttntgacaagggggcccaaagaggggggcgtaataaaaggaagagcaggggcgcggttaaacagttgggngtgggaaaatggtcctgggattcggggagggacctaattgcggggggacatgggacataaaccagagttaaggtcaggaataaacttaggtgagggtgacaacgctatgtggcggaattgtcggtttataacagaaaaagaaaataggagataagaagagagttagaatggaaaaa

SEQ ID NO: 453024 - DNA, 908 bp, Homo sapiens
  misc_feature (643)..(643): n is a, c, g, or t
  misc_feature (646)..(646): n is a, c, g, or t
  misc_feature (649)..(653): n is a, c, g, or t
  misc_feature (658)..(658): n is a, c, g, or t
  misc_feature (661)..(661): n is a, c, g, or t
  misc_feature (665)..(665): n is a, c, g, or t
  misc_feature (732)..(732): n is a, c, g, or t
gcggccgcctactactactaaattcgcggccgcgtcgacggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctgaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaaccagtccctccaaaaaaaaaaaaagaaaacgagaaaaaaaaaaaaaaaaaaaaaaaaaaaaaaagggggggggggaaaaaaaatccccggggggcccaanttnggnnnnnccggnttntttntgacaagggggcccaaagaggggggcgtaataaaaggaagagcaggggcgcggttaaacagttgggngtgggaaaatggtcctgggattcggggagggacctaattgcggggggacatgggacataaaccagagttaaggtcaggaataaacttaggtgagggtgacaacgctatgtggcggaattgtcggtttataacagaaaaagaaaataggagataagaagagagttagaatggaaaaa

SEQ ID NO: 453025 - DNA, 4809 bp, Homo sapiens
cccgccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcgggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagatgtggtccttaggagacgctgcacttgacaccaaccagacagcacagggcaggggtggtggagggggctgggctcacaggcctctcttttccccgcctgcagtcttctgggctgcgggaggccctggccctttccccttcccctcccctccttgtctagtttcccacattccaaaagggggcctgggatgctagccccagagatgccagcccttcaggaagcaggtgtcctttcccctctctgcccctgatcactcccagcactccccttgccttcccctgtcttcacctgccacacacacacacacacacacacacacacacacacacgcatggcttcctataacttcttcctgctggacagagactcagcgctcctcctgtgtgactggcaagaggcctcatgcctgctgagagaggaggagtgggagaggggcttgccagacaccagagagggagaccccaggcccacaggacctggctgtcgaacccgcattgctgctcaggtgccgtgatctcccgtggtcggcaccaggcccttgccagctcatggcctcatcttctcccctgtccatccaggtgggccctccctgcttctaaagccccacagaagttcccatggaaacactagaggccgggtgtctccttccacctccagtgatctgggaagtgacccagccgcctgcccttgttaagcctggtctgccccgtgggaagtgacttcatgttgcacatgtgatttcagcccccgaggcttgcgcgaggcttctggaccctcggttaaaggtcagcccctggccgggtgcggtggctcacgcctgtaatcccagcactttgggaggccaaggcgggtggatcatggagtcaggagatcgagaccatcctggctaacacggtgaaaccccgtctctactaaaaatacaaaaattacccaggcgtggtggcgggcgcctgtagtcccagctactgaggaggctgaggcaggagaatagcgtgaacccgggaggcggagcttgcagtgagccaagatcacgccactgcacttcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgaccctcccaaccttggctatctaccccacctgtggagaggaggtctggggtgacatctattgtagatcccacctgagagtttaaccaatgagaagacttactttcctggtaggcagcctgctttgttttgcacaggaagatagattttttttctcatctttcttataaacaacctcatgcacattctgtgtttgagccaagactagtcacccattgggggctaaccgtgcagtgtgagctgcgtccacaccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgcctta

SEQ ID NO: 453026 - DNA, 4731 bp, Homo sapiens
ggcttacccctcccgggctaggacatcctcctctcccccttctgtttctgcgtgaggcgcacaaaagggcggggagccgggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcgggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagatgtggtccttaggagacgctgcacttgacaccaaccagacagcacagggcaggggtggtggagggggctgggctcacaggcctctcttttccccgcctgcagtcttctgggctgcgggaggccctggccctttccccttcccctcccctccttgtctagtttcccacattccaaaagggggcctgggatgctagccccagagatgccagcccttcaggaagcaggtgtcctttcccctctctgcccctgatcactcccagcactccccttgccttcccctgtcttcacctgccacacacacacacacacacacacacacacacacacacgcatggcttcctataacttcttcctgctggacagagactcagcgctcctcctgtgtgactggcaagaggcctcatgcctgctgagagaggaggagtgggagaggggcttgccagacaccagagagggagaccccaggcccacaggacctggctgtcgaacccgcattgctgctcaggtgccgtgatctcccgtggtcggcaccaggcccttgccagctcatggcctcatcttctcccctgtccatccaggtgggccctccctgcttctaaagccccacagaagttcccatggaaacactagaggccgggtgtctccttccacctccagtgatctgggaagtgacccagccgcctgcccttgttaagcctggtctgccccgtgggaagtgacttcatgttgcacatgtgatttcagcccccgaggcttgcgcgaggcttctggaccctcggttaaaggtcagcccctggccgggtgcggtggctcacgcctgtaatcccagcactttgggaggccaaggcgggtggatcatggagtcaggagatcgagaccatcctggctaacacggtgaaaccccgtctctactaaaaatacaaaaattacccaggcgtggtggcgggcgcctgtagtcccagctactgaggaggctgaggcaggagaatagcgtgaacccgggaggcggagcttgcagtgagccaagatcacgccactgcacttcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgaccctcccaaccttggctatctaccccacctgtggagaggaggtctggggtgacatctattgtagatcccacctgagagtttaaccaatgagaagacttactttcctggtaggcagcctgctttgttttgcacaggaagatagattttttttctcatctttcttataaacaacctcatgcacattctgtgtttgagccaagactagtcacccattgggggctaaccgtgcagtgtgagctgcgtccacaccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgcctta

SEQ ID NO: 453027 - DNA, 2833 bp, Homo sapiens
cccgccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgaagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgccttagctgctctctaggtttgtggggttaagttgccagaaaattgtgctactgtgtgtgcgtgtgcgtgcgtgtgtgtagtgctaggagtccacagtaggtctctgtcaagccgatgtcgtgatgagggcttttctgatactgacccagaagccacagaaccacaaggaaacccaaaccccctccagctgctgaggcgcaggcacagcctggggtcggatggagcctccagcaccccagcacccaggtgacttccccactcccctgtaaatgtcatggtgctaagactgtgtcaaccccaagacgacacatggtcctgtgctttggccaccgtttgaggcaaaaactaaacagcccgacacgttgtgttctggtgcaggtttgtattaaactgtagctacttctca

SEQ ID NO: 453028 - DNA, 1278 bp, Homo sapiens
cccgccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagtgctaggagtccacagtaggtctctgtcaagccgatgtcgtgatgagggcttttctgatactgacccagaagccacagaaccacaaggaaacccaaaccccctccagctgctgaggcgcaggcacagcctggggtcggatggagcctccagcaccccagcacccaggtgacttccccactcccctgtaaatgtcatggtgctaagactgtgtcaaccccaagacgacacatggtcctgtgctttggccaccgtttgaggcaaaaactaaacagcccgacacgttgtgttctggtgcaggtttgtattaaactgtagctacttctca

SEQ ID NO: 453029 - DNA, 481 bp, Homo sapiens
cggccgcagcatctcggaggagtgggtgatggcaggggggtcggtgggcttacccctcccgggctaggacatcctcctctcccccttctgtttctgcgtgaggcgcacaaaagggcggggagccgggtgagcctggggcccggccgcaggggacgcggcgggaggtgtggtttggggttgggaggtggccatcggggctaagccggggcgctcttggggtcctctttgtacgcccgcgaagcgccgtgccgggccttgctcatagtaagcgtttaatgcgtgctcgcggggttgcaaagccctggggtgaggaggcggctcggccgaggggtttcgcgcctagcacgcagtgggccgctttcctagccgggcgcggtgcagtggaccgctggagggctgggcgggggcgcctctggccgggggccagtcctgccggtcccaggatctgcgctgtccccggtcccacacaccacccagatac

SEQ ID NO: 453030 - DNA, 271 bp, Homo sapiens
tctggtgcaggtttgtattaaactgtagctacttctcacttggactctgttgtgtttcttcaaagaggagggagtttggcagagatctcttctacggtggctgggcaaggcttcagttgctaagaaaaggcagctttgatctgtctctcctattgggtggcagctcactgggaggcttgtgcagagactggatttttttttttttttaattctgagagacaggagccccagtggtgccagatttccagggacaaggttgccaaattatctg

SEQ ID NO: 453031 - DNA, 622 bp, Homo sapiens
cccgccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggtaatgctcctgtttgccaaaggtggcttcctctttggcttttttattctgcttctagggctgctccagactagactcatgtgagccaggtgctcccagtgtattgctggcaggagaagggtgtgtcagggccactgtggcaactacaatagggatttccggcttaacgtcacagatttccatgattatagaaaaggag

SEQ ID NO: 453032 - DNA, 5211 bp, Homo sapiens
cccgccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcgggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagatgtggtccttaggagacgctgcacttgacaccaaccagacagcacagggcaggggtggtggagggggctgggctcacaggcctctcttttccccgcctgcagtcttctgggctgcgggaggccctggccctttccccttcccctcccctccttgtctagtttcccacattccaaaagggggcctgggatgctagccccagagatgccagcccttcaggaagcaggtgtcctttcccctctctgcccctgatcactcccagcactccccttgccttcccctgtcttcacctgccacacacacacacacacacacacacacacacacacacgcatggcttcctataacttcttcctgctggacagagactcagcgctcctcctgtgtgactggcaagaggcctcatgcctgctgagagaggaggagtgggagaggggcttgccagacaccagagagggagaccccaggcccacaggacctggctgtcgaacccgcattgctgctcaggtgccgtgatctcccgtggtcggcaccaggcccttgccagctcatggcctcatcttctcccctgtccatccaggtgggccctccctgcttctaaagccccacagaagttcccatggaaacactagaggccgggtgtctccttccacctccagtgatctgggaagtgacccagccgcctgcccttgttaagcctggtctgccccgtgggaagtgacttcatgttgcacatgtgatttcagcccccgaggcttgcgcgaggcttctggaccctcggttaaaggtcagcccctggccgggtgcggtggctcacgcctgtaatcccagcactttgggaggccaaggcgggtggatcatggagtcaggagatcgagaccatcctggctaacacggtgaaaccccgtctctactaaaaatacaaaaattacccaggcgtggtggcgggcgcctgtagtcccagctactgaggaggctgaggcaggagaatagcgtgaacccgggaggcggagcttgcagtgagccaagatcacgccactgcacttcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgaccctcccaaccttggctatctaccccacctgtggagaggaggtctggggtgacatctattgtagatcccacctgagagtttaaccaatgagaagacttactttcctggtaggcagcctgctttgttttgcacaggaagatagattttttttctcatctttcttataaacaacctcatgcacattctgtgtttgagccaagactagtcacccattgggggctaaccgtgcagtgtgagctgcgtccacaccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgccttagctgctctctaggtttgtggggttaagttgccagaaaattgtgctactgtgtgtgcgtgtgcgtgcgtgtgtgtagtgctaggagtccacagtaggtctctgtcaagccgatgtcgtgatgagggcttttctgatactgacccagaagccacagaaccacaaggaaacccaaaccccctccagctgctgaggcgcaggcacagcctggggtcggatggagcctccagcaccccagcacccaggtgacttccccactcccctgtaaatgtcatggtgctaagactgtgtcaaccccaagacgacacatggtcctgtgctttggccaccgtttgaggcaaaaactaaacagcccgacacgttgtgttctggtgcaggtttgtattaaactgtagctacttctca

SEQ ID NO: 453033 - DNA, 3721 bp, Homo sapiens
ggcttacccctcccgggctaggacatcctcctctcccccttctgtttctgcgtgaggcgcacaaaagggcggggagccgggaacatgcttgccaactcagccagcgtgaggatcctcatcaagggaggcaaggtggtgaacgatgactgcacccacgaggctgacgtctacatcgagaatggcatcatccagcaggtgggccgcgagctcatgatccctggcggggccaaggtgattgatgccacaggaaaactggtgatccctggtggcatcgacaccagcacccacttccaccagaccttcatgaatgccacgtgcgtggacgacttctaccatgggaccaaggcagcactcgtcggaggcaccaccatgatcatcggccacgtcctgcccgacaaggagacctcccttgtggacgcttatgagaagtgccgaggtctggccgaccccaaggtctgctgtgattacgccctccacgtggggatcacctggtgggcacccaaggtgaaagcagaaatggagacactggtgagggagaagggtgtcaactcgttccagatgttcatgacctacaaggacctgtacatgcttcgagacagtgagctgtaccaagtgttgcacgcttgcaaggacattggggcaatcgcccgcgtccatgctgaaaatggggagcttgtggccgagggtgctaaggaggcactggatttggggatcacaggcccagaaggaatcgagatcagccgtccagaggagctggaagctgaagccactcatcgtgttatcaccattgcaaacaggactcactgtccaatctacctggtcaacgtgtccagtatctcggctggtgacgttatcgcagctgctaagatgcaagggaaggttgtgctggcggagaccaccactgcacatgccacgctgacaggcttacactactaccaccaggactggtcccacgcggctgcctatgtcacggtgcctcccctgagactggacaccaacacctcaacctacctcatgagcctgctggccaatgacactctgaacatcgtggcatcagatcaccggcctttcaccacaaagcagaaagctatgggcaaggaagacttcaccaagatcccacatggagtgagtggcgtgcaggaccgcatgagcgtcatctgggagagaggagtggttggaggaaagatggatgagaaccgttttgtggccgttaccagttccaacgcagctaagcttctgaacctgtatccccgcaagggccgcattattcccggagccgatgctgatgtggtggtgtgggacccagaagccacaaagaccatctcagccagcacgcaggtccagggaggagacttcaacctgtatgagaacatgcgctgccacggcgtgccactggtcaccatcagccgggggcgcgtcgtgtatgagaacggcgtcttcatgtgcgccgagggcaccggcaagttctgtcccctgaggtccttcccagacactgtctacaagaagctggtccagagagagaagactttaaaggttagaggagtggaccgcactccctacctgggggatgtcgctgttgtcgtgcaccctgggaaaaaagagatgggaaccccactcgcagacactcctacccggcccgtcacccggcatgggggcatgagggaccttcacgaatccagcttcagcctctctggctctcagatcgatgaccatgttccaaagcgagcttcagctcggatcctcgctcctcccggaggcaggtcgagtggcatttggtaaaggcattgccaagccccccgagtgaggacgcaccgccgccaccagcccgcaactctccagccgaagctgcaggggcaggagaggctgggctgggtggcacaccacccgaggggggccccgggacccacggagccctccctatgtctgcaaagtgattcactgtgcttcgagccaactctaacaggcactttgagatgtgttcctcctgctgtagtcctttctgccttggcctcggcgggcttttctggggcccaggaagcccacactatgcacagagcccaatgcatagagccctggccagcccttcctctcactcctgcctccgctggctttgggaaagcccagactttagtgccctgccccctggctgactggccagttgcccagagcactttagcagatgtggtttcaaagtaaaggcctcctcccccaccccttaggccccgtggtgacatttcccaagtcagacagatgtcagcttcccagccatgcccaggacgtcctatctcccccaacccacctctggccctgtgtaggggcagggatgggggtggctgggactcctggtgcccctcgccagcttctcctgcgccccgcccacaccctcgggggggtcacaggcccagaagggtagctgggcggggctcgaggctggtgccaggcgcgtgtaaatggttttgttttgcacgtttggtttgcgcagtagtttggtttgacttgtttgtgcatcctgtgaaaaataacggtgcttgtgtcactagcatagaatagcgacaggaatagattttttttctcatctttcttataaacaacctcatgcacattctgtgtttgagccaagactagtcacccattgggggctaaccgtgcagtgtgagctgcgtccacaccctcacttctcccttcactccccctttcctcactcaggggctgagaggacagaggtggtcagccggggagcagaggtggcgaaggggctcatggcaagtggcagccattggaacaggggtgaggacccaggcctgggaaagccaccagggatgggggaaaccatgacgccgcctcctggtgcagtgcacaccatctctatccctgtcagccctcactgggtcatgggccttgggcagatgtcaaagagcccagcagcagcggtggtggccagctgggcagagcatccttgcttgggctaggaaagctttaccttctctgagtgcctccgcctgagagatgtgtgacccgtggcaccagggaaccacgtcttggagtggtccactgtaggccatgcgcttcatccacccccagtccctacataggccctacccttgcccgggagcttctagatagaaatcagaaagagattcaaggagccaaatgagcggtcagcccccaccatgcactccttgccccgtgcagagctccagccagcttcgtcaccagccccactggctcctggttggaacgaaagggtctctggttgcactgaatgcagctctcaaactggtcttgtacttgctgaataaatactgttgttcttgccttagctgctctctaggtttgtggggttaagttgccagaaaattgtgctactgtgtgtgcgtgtgcgtgcgtgtgtgtagtgctaggagtccacagtaggtctctgtcaagccgatgtcgtgatgagggcttttctgatactgacccagaagccacagaaccacaaggaaacccaaaccccctccagctgctgaggcgcaggcacagcctggggtcggatggagcctccagcaccccagcacccaggtgacttccccactcccctgtaaatgtcatggtgctaagactgtgtcaaccccaagacgacacatggtcctgtgctttggccaccgtttgaggcaaaaactaaacagcccgacacgttgtgttctggtgcaggtttgtattaaactgtagctacttctca

SEQ ID NO: 453034 - DNA, 3865 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctaca

SEQ ID NO: 453035 - DNA, 3071 bp, Homo sapiens
gcagagatgagaggcgttgcaacagcaaccggatgccccaggcgagagggaagcaggtccggcgaagccggagaggagaagaagagaagaggcttacatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctaca

SEQ ID NO: 453036 - DNA, 4060 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctacaaaaaaaaaaaaaaaaaaaaagctgttcacacagatgtttagacctttctctctctctctctctcttttcttctttctcaacaactctttcacagaggcagtcattttgaaaggttgaaatatttggcctttaccaaagagctttttttttccttaagcaaaatcctttcagaaagaacaatggggaagggcagat

SEQ ID NO: 453037 - DNA, 3446 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtagccgcatccaaagcggggatcctcagaacagc

SEQ ID NO: 453038 - DNA, 3812 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagatatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctaca

SEQ ID NO: 453039 - DNA, 1417 bp, Homo sapiens
caggctgatctagaggatcccgcttggatgcggcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctaca

SEQ ID NO: 453040 - DNA, 1364 bp, Homo sapiens
caggctgatctagaggatcccgcttggatgcggcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagatatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctaca

SEQ ID NO: 453041 - DNA, 2850 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctaca

SEQ ID NO: 453042 - DNA, 448 bp, Homo sapiens
agctcggccagtctgtctaccatccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctaca

SEQ ID NO: 453043 - DNA, 967 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagaatctacatcggtcaaaaaaaaaaaaaaagttggggccgcccgaaagtaaaacattgggggccagaaaagatgtcaacgccaagggggccaaacgggcgggaccgctgtttacgttcccccccgtcggacatcaagaaaaacag

SEQ ID NO: 453044 - DNA, 4350 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaagagaggggggggcgcggggaagcgagcagcggcggggggaggaccgcggagtgtgagaaaaacagaagcgaggcaaagaaagtgagcggcaccacacaggcgaggaaaaaaagaaaagaagaaagagaggggggaaggaagagacaaaaaaagggacagggagagaaagacagagaagaagaagaaaaggaagaaaagaaggaacaacgagagggagggagggacgaaacaaacgcgaagaaacaaccggacgagcagtaatgagcggaaccgcgagtagcataaacgaaaaggaagaatagaaggagacaaagaaagagaagaaacaacacggagaaaaagtaagagaaaaaaatagaaaaaaacgaggagaaggag

SEQ ID NO: 453045 - DNA, 4133 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctacaaaaaaaaaaaatatgaacaacgaaagcgaaccaaaaccgaagcaacgcacaccacaaagggcggggccgcaaaaaacggcccgagggcgcgcaagtgcccgtacacgttctttgcaacaggcgcgatcaagggggccaaaatccaggcgcgcggcatacaacgcgcgagacaaccgccgccgatgtggagagcccaccggtgggcggacacgacaaccaagatagccagcaccactggatctgccaccctccgccacagccgtatgat

SEQ ID NO: 453046 - DNA, 3335 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacggatcctggggacttagaactgtattataggctattcgtcaatccagactggatttccaagaggtctctaccctagtccctttttcc

SEQ ID NO: 453047 - DNA, 2011 bp, Homo sapiens
gcgccgcggacccagagagagggttccgcggaggagaagaggaagaggaagttgggggagggtcctagcggggagtgaaccggaagtgtaaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctcgcattatattacacatagctcccattctactccactgaccgctacacccgccgtccgtatcctccctctccccg

SEQ ID NO: 453048 - DNA, 4483 bp, Homo sapiens
aaccatgtagaatgaagcaggagacctggaaggaagcagaaaagccactgagagataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggtggccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccagaacagaaggagggtggaggaagtgatcagagggaacgagctgtaggtttgcagaaatgtgtgaaaccaaaatgatcactgcctacttgtgattcaaatcttcagagttttcctagttcttctagaaatacatgtcaggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactgaatgta

SEQ ID NO: 453049 - DNA, 4197 bp, Homo sapiens
  misc_feature (24)..(24): n is a, c, g, or t
ttctagaggacccctgcaaacggntggcatcaaatgcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggtggccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccagaacagaaggagggtggaggaagtgatcagagggaacgagctgtaggtttgcagaaatgtgtgaaaccaaaatgatcactgcctacttgtgattcaaatcttcagagttttcctagttcttctagaaatacatgtcaggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactgaatgta

SEQ ID NO: 453050 - DNA, 5366 bp, Homo sapiens
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggtggccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccagaacagaaggagggtggaggaagtgatcagagggaacgagctgtaggtttgcagaaatgtgtgaaaccaaaatgatcactgcctacttgtgattcaaatcttcagagttttcctagttcttctagaaatacatgtcaggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactgaatgtattcttctgtcacctcctttttatgttcattgccatcggagttttttcactgctaaatattattccattatgaatatatcacatgttctcttctccagctggtgcttattgaactgcatctttgtttgaaatagaaaaaggtaatgttgctctgaatattcttttatgtgacttctggtgtacatactgaagaatggatgtataccttgaatagaattgctggtttatacaataaaagcacatcatcagttttaatagataaggccaaattgctttccagagtactaatttatgctccccaccagtatactagaatttgcaggactctaaatctttgccaatgtttgagattgtcagagttgcatttttgccaagctggggagtataaaatgttacctcattgtggtttcattttgtaaatttttgattattagtaagttgaacatgttttattatgggaattcttgtttctttttcttggcaatccctcttcatgtcttttgcctttcttcctattgagttgtgttttaatgattaatttttaaagtttctttatatttaatatttaattggtcgacatttatttaatcattaaagtgaagagaaaccagatttagagtagaaaacttttctgaggccatttccagaaatatgctaagcatgtgaatctttattctatttggagaaaataaagttaaatacatataaatattt

SEQ ID NO: 453051 - DNA, 3643 bp, Homo sapiens
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacgcaaaaaaaaaagaaaaaaaaaaaaaaaaaaatgtttgtggggggggggcctcgaaaaaattttttaaaacaacttggttgtgggggggggcccagtgggttattggaaacgtgggcaaagggggtccaggggaaaccggggag

SEQ ID NO: 453052 - DNA, 571 bp, Homo sapiens
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggtaggtaaatcttttcttattcttgttttagaattcatctcttttgaatttttcttagagatgtagagtgacggtgttag

SEQ ID NO: 453053 - DNA, 4653 bp, Homo sapiens
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggtggccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccagaacagaaggagggtggaggaagtgatcagagggaacgagctgtaggtttgcagaaatgtgtgaaaccaaaatgatcactgcctacttgtgattcaaatcttcagagttttcctagttcttctagaaatacatgtcaggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactgaatgta

SEQ ID NO: 453054 - DNA, 3881 bp, Homo sapiens
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaagggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtgaggcagcagcacagtgtgtggcatttacatggtacccaggctccacagagtaccaagatgttgccctctgggaccacacttagctcagagaatatggggtccttacttgtattcttttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcacagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactgaatgta

SEQ ID NO: 453055 - DNA, 1497 bp, Homo sapiens
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcctacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagt

SEQ ID NO: 453056 - DNA, 5267 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453057 - DNA, 790 bp, Homo sapiens
gatcaggaagggagctcagctccacattagttgcaccatcaaagtgactcacttgccccaggagttcccagaaatcatattcagaaaggacaagcgatttgtggccccaccagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453058 - DNA, 231 bp, Homo sapiens
atgcgtttcagttgactgtattgcattgttcacactttttaggaatataggaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453059 - DNA, 5213 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453060 - DNA, 5214 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453061 - DNA, 5212 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453062 - DNA, 5213 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcaggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453063 - DNA, 5213 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaattggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453064 - DNA, 5399 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaaggagttgctttttaatttcaactttttctatacttagtataaatattcagataacaggtaaatatatttattttctgatttaattttaactaaaagctgccaataaaaatttccatgtagctttaaccaccc

SEQ ID NO: 453065 - DNA, 5556 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaagaaaaaaaaaaaaataaaaaaaaaaaaaaactttttgggcggcatagggcctaggaaaaagttttataaacaatcgttgggggggacgagccccagaaaggaaagtgagcaacaggcgaccaaaagcgtaaccatgagaagacaccctggcacaagaactaagaggctggaaattccacccaataaaaaaaaggcccggagaaccagaagcgtcgtgaaacaaacccgaagaaaccgagagacacacggaactaaaaaaggagtcaacaactgaaataatacgggaata

SEQ ID NO: 453066 - DNA, 5212 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaactatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453067 - DNA, 5213 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaatctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453068 - DNA, 4681 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtacagctacctttccggtccgagcgcgat

SEQ ID NO: 453069 - DNA, 944 bp, Homo sapiens
  misc_feature (13)..(13): n is a, c, g, or t
tcggcggtccggnaaggtagctgtactgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453070 - DNA, 911 bp, Homo sapiens
tgcttggcagacgttaactgggctatctatagccagacagaattccactctgtccattctaaattctactgtgaaatatctctatcatgatggaacattccttgattacttcatcatagtcttatctgtggggcctgagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctgtattatttgtgatgtcttattgtttgtgagcttttgttttttttttaaagaaaaaacaaaaactaagtgggactatgtatgtagatgtgtgtcagtaccaaaaagttattttctcaaatccctaaatttctgatttccattcaagtcttttaaactctttcctgctgaatagcaaagaacttttattttccactttcctatattcctaaaaagtgtgaacaatgcgtttcagttgactgtattgcatacttttttgctgaagactttttctgtaaacacaattgccttgttcagttttgttgtaaactgacttaccataagatgcactgttgataatgctttctgatgtgtgtttgataagagtgataaaataaaagcttaaaaataaa

SEQ ID NO: 453071 - DNA, 4183 bp, Homo sapiens
gaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattccaatattatatatgatggaaaagccagaattgtctggcagaatttaattcttccttggatctctagttctgtttttaatatcaggttccttcatcaaattttactactgtagctctgtgatataatttcatttcttgtcaattatggtcacatatagacaagtacttggtcacaattagctcaaaagaatccccatttcttaaggtgctcagtcaatcacctttattttgagatggtagtttttcaagttagtattacttactagctttcttgatgaatataaaaatgttgtctccatcatacagagctgagcctcttgtggtatattaagataagtcccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcagtacattttcatgatttgagaagccttcgcattcgaagcgaaaagtcctcaatagtagaagaacccgtccataaatcctggagtgactatatggatgccccccaccctaccacacattcacttgta

SEQ ID NO: 453072 - DNA, 5823 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggagagcttgtttgagtgcccctggccactggtgatcaatgccgagagctgctaggaaggcagtgtgtgctgaacagtggatgtttctgacattcttcaaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453073 - DNA, 5199 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggagagcttgtttgagtgcccctggccactggtgatcaatgccgagagctgctaggaaggcagtgtgtgctgaacagtggatgtttctgacattcttcaaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453074 - DNA, 6217 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggagagcttgtttgagtgcccctggccactggtgatcaatgccgagagctgctaggaaggcagtgtgtgctgaacagtggatgtttctgacattcttcaaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagcaaaaaaaaaaaaaaaaaaaaaaaaaaaaaaaaaaaaaaaaaaaacaaaaaaaaaaaaaaaaaacaaaaaaaaagaaaaaaaaaagagagaaaacaaaaaacaaaaccagaaaacaaaaaaaaaggagggggggcggggccgcgcgcacgaggagaggacgccgacacacaagggggtgggggcgggcgccgcacataacaatagaagaagaaggagggcaagacagagtggcgacaccaaaagatgacatgggactcaaaaagaagagggggtgagcctcccacacaaaaaaaacaagcggggggggacaaaaagactgtggtaaaacaacacaaacaaaggcacgaggagaacagcgaggacaacacaagggggcaagaggaggacaaataacc

SEQ ID NO: 453075 - DNA, 5275 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453076 - DNA, 6924 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggctgtgcacgtccaggctcgctgcttcatttcctcattggccaaaggagaaggaaagccttcagggttacggagctctgtgtgtctcaagcctggcccactgtgggtgctcaaatgagagtcctactccccataaaaacccagtggccgcctctgggtgtagctgcctctcatgatgcagtttgagcccgtgatgccaccttgtacaggaagctacacagtcctcggcctccatgcttaagggaaagttggcccaagtcatggtctgccaccggccacagcaccggtgaggagggaggagtgcattcagaaatgtttgggcacctaacagtttttacagcattctactttttgtcaattggttaaccagtaattcgctgtgaaccggaaggccccatttccaaaagcttacttagtgcaggaattctctgtgcaggccccagggagaaggggttccttctctggaagccagtcgtcttgtgtctggggcttgacctcgggtagtggtgccagggcagcgccctgcactctgcccagcatccagggactggccagatcccctccctgggctccctggccttggcatcagcctgggctcccaaactaggcccttcccaattcaaggccacgatgtgtgccttcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453077 - DNA, 6143 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453078 - DNA, 6423 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaagaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagaggtctgtgactcctgccccccagtgtgcaacttctccactctccaacacctgcacttggatttttacatttgcattcagcatacctggtgtcctcctcagaaacacttttcataggaagagcttgatgcctgctgtcctcttcttccttcccctgccttgtctcacttgtgggtcaggtaaagggaggacagtggtgctgggatcccttgaatgctctacatttttggctgcaagggtaatccagtcttttgacatttaaactctggaaggagacctcagggcttgttccctcagattccttcttggttgatgtctagaatcatatttctagctctgtgtcctcaaacagccctttccactttgtaccttgttgtgccagatcatacctctagggaattgttgagaaagcctgattgctgtttaaaggtacaatggaagtcttgagtttgagaagtaatgttgactttgcccttccttctccctagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453079 - DNA, 4112 bp, Homo sapiens
gggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcacaattatggaggcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453080 - DNA, 3993 bp, Homo sapiens
gggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcacaattatggaggcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453081 - DNA, 3327 bp, Homo sapiens
ggccaacagactcttccctgggccctgtgctgttcagcactgtttttatagtcactgctctgaaataaaaacctcagcaccccaagtactaggaatgcattagatgatggaaccagaagccaggaaggcctcaacagattagaatcaagagacaaactaaacagatgatttagtaggagaactccaaagttgtggttctggggctgtgcatgttgaggtctggatggagtagatgtgctgaatggctgtgtcctaacagagctgaccaccagccagaagtccaggcccagcaccacccccacatctcggtctctgctccctgcgttgatccctgccatccacctgctctgctgccaatagaaagatctgacagcagccagattcaagaagtgaagagctgggcttgctccttgcaaggcacttgacctctgcctctccccgtctttttgccttgcagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453082 - DNA, 4269 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggagagcttgtttgagtgcccctggccactggtgatcaatgccgagagctgctaggaaggcagtgtgtgctgaacagtggatgtttctgacattcttcaaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaaaaaaaaaaaaaaaaaaaaaaaaaagggtattggaagcaagtcggacccattgccgttggtcccttctgcctcttcatatttgacatgtgtgagagaggggtacaactcacgaatcccttctaca

SEQ ID NO: 453083 - DNA, 2552 bp, Homo sapiens
ccgtcctactctactccgaaatgccaacacattcccctccatgacatcccgaagtcttaatacaaatgtttgaacaaggattgggtgagaaaaaaaccttttgtattgatcatgcagggtctgcttgttgatatttcagccttgactttttatgagaaaggatggttcccaagcatgtgccatcttaattccatcattatcatggatgtttgtgctgggccctctcatctccgggaagctttatttccccattagagtcctccctattaattactcccatcttctcccccagcttgtttgccatgaactgattcctggagggaagaccattcctgttacaaatgaaaataattcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453084 - DNA, 3688 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgaggtaggaacgttaagaaacagagaaatgtaaaataaaatgttaacggtaccatgggcttcttcacatacacatatgtgatcaggcttggccatgtaaactgtcactaggatacaagcgaggacaggggcaggaaccaaggtttgttgtacaccagtgctaggtactt

SEQ ID NO: 453085 - DNA, 1377 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttcta

SEQ ID NO: 453086 - DNA, 1864 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagaggtctgtgactcctgccccccagtgtgcaacttctccactctccaacacctgcacttggatttttacatttgcattcagcatacctggtgtcctcctcagaaacacttttcataggaagagcttgatgcctgctgtcctcttcttccttcccctgccttgtctcacttgtgggtcaggtaaagggaggacagtggtgctgggatcccttgaatgctctacatttttggctgcaagggtaatccagtcttttgacatttaaactctggaaggagacctcagggcttgttccctcagattccttcttggttgatgtctagaatcatatttctagctctgtgtcctcaaacagccctttccactttgtaccttgttgtgccagatcatacctctagggaattgttgagaaagcctgattgctgtttaaaggtacaatggaagtcttgagtttgagaagtaatgttgactttgcccttccttctccctagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttcta

SEQ ID NO: 453087 - DNA, 5726 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453088 - DNA, 5381 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaagaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453089 - DNA, 6281 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453090 - DNA, 6768 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagaggtctgtgactcctgccccccagtgtgcaacttctccactctccaacacctgcacttggatttttacatttgcattcagcatacctggtgtcctcctcagaaacacttttcataggaagagcttgatgcctgctgtcctcttcttccttcccctgccttgtctcacttgtgggtcaggtaaagggaggacagtggtgctgggatcccttgaatgctctacatttttggctgcaagggtaatccagtcttttgacatttaaactctggaaggagacctcagggcttgttccctcagattccttcttggttgatgtctagaatcatatttctagctctgtgtcctcaaacagccctttccactttgtaccttgttgtgccagatcatacctctagggaattgttgagaaagcctgattgctgtttaaaggtacaatggaagtcttgagtttgagaagtaatgttgactttgcccttccttctccctagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453091 - DNA, 5719 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggagagcttgtttgagtgcccctggccactggtgatcaatgccgagagctgctaggaaggcagtgtgtgctgaacagtggatgtttctgacattcttcaaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcaggcgtccctgagcgtcagtttgcccccgagaagcagctaggcccatagttagcagctcgctggt

SEQ ID NO: 453092 - DNA, 6169 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacgccctgtgattgctgcacagttctcagacaatctgattcggccgttcctcatccacatcatgtctgtgcctgctctggtgactcatctcagcacagtgacccctgagcgcctcactgttttagaatcccatgacatgcttcgtaaattcatcatatttttaagagaccaagatcgatgccgtgatgtatgtgaaagtttagaaggatgccatacgctttgtctaatgggcaacctcctacacttgggctccctcagccccagagtgttagaggaggagacagatgggttcgtgagtttgctcacccagacgctgtgctactgtcggaagtatgtgtctcagaagaagtccaacctgacccactggcatcctgtccttggctggttctcccaatctgtggattatggccttaacgagtcaatgcacttgatcaccaaacagctgcagttcttgtggggggtgcctctgatccggatcttcttctgtgacatcctgagcaagaagctactggagagccaggagccagcccacgcacagccagcatcccctcagaatgtgctcccagtgaagagtctcctaaagcgtgcttttcaaaagtcggcatcagtccggaatattctcaggcctgtcgggggtaaacgggtcgactctgcagaagtccagaaggtttgcaacatctgtgtcctctaccagacctcgctgacaactctcacacagattcggctgcagatactcacaggtctcacttaccttgatgacctgcttcccaaactgtgggcatttatctgtgagctcgggccccacggagggttaaagctcttcttggaatgcctgaacaatgacactgaagagtccaagcaactcttggccatgctgatgctgttctgtgactgttcgcggcacctcatcacaatccttgatgacattgaagtttatgaagaacagatttcattcaaactggaagagctggtcactatctcctctttcctgaattcttttgtgtttaagatgatctgggatggaattgtagagaacgccaagggtgagaccttggagctgttccagtctgtccacgggtggcttatggtgctgtacgagcgggactgccggcggcgcttcacccccgaggaccactggctgcgaaaggatctcaaacctagcgtgctcttccaagaactcgacagggacagaaaacgggcacagttgatcctgcagtacatcccacatgtcatccctcacaaaaacagagttctactgtttcgaaccatggttaccaaggagaaggagaaactggggctggtggaaaccagctctgcctccccgcatgtcactcacatcaccatccgccggtccaggatgctggaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaattcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453093 - DNA, 3173 bp, Homo sapiens
taccttgtttgtgtcactccttactggagagcttgtttgagtgcccctggccactggtgatcaatgccgagagctgctaggaaggcagtgtgtgctgaacagtggatgtttctgacattcttcaaggacggctacgagcagcttaggcagctctcccagcacgccatgaagggggtcatccgtgtgaagtttgtcaatgacctcggggtggacgaagcagggattgatcaagacggtgtttttaaggagttcttggaagagatcatcaagagagtttttgacccagcactcaatctgttcaagacaaccagtggggatgagaggctgtacccctcacccacatcctacatccatgagaattacctgcagctcttcgagtttgtggggaagatgctggggaaggctgtgtatgagggaattgtggtggacgtgccatttgcatccttcttcctgagccaactgcttgggcaccaccacagcgtcttctatagctcggtggatgaactgccttctctggactccgagttctataaaaacctcacctccatcaagcgctatgatggggacatcactgacctgggcctgacgctgtcttacgacgaggacgtcatgggtcagcttgtttgccatgaactgattcctggagggaagaccattcctgttacaaatgaaaataaaattagctacatccatctgatggcacattttcgaatgcacactcaaataaaaaaccaaacagctgccctcattagcggattccgttccattatcaaacccgagtggatccgaatgttctcaactcctgaactgcagcgtctcatctctggcgacaatgctgagattgatctggaagatttaaagaagcacacagtctactacggtggtttccatggaagtcacagagtcatcatctggctctgggatattctggcctccgacttcacaccggatgagagagctatgtttctgaagttcgtgaccagctgctccagacccccgctcctgggattcgcctacctcaagcctccattctccatccgctgcgtggaggtgtcggacgatcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453094 - DNA, 3051 bp, Homo sapiens
atatctcagcaaggcaggcagctggacccctcagagccaagtgaggagggccccacagttctcacggcaggagaaccagccagccccagagagactgcccacggactcagccctctctcggcagcccctttctctttccttcctcagggaagggtacctggagtgggggtgggtacgtgctgtttttagtggcgtctggcctcaccagggctccagatctgaggcagcatgggagaaagtgagagagtgggctcaggaggcaggcaggcgcagactcgaatgctactcctaccccagcaggctgtgcacgtccaggctcgctgcttcatttcctcattggccaaaggagaaggaaagccttcagggttacggagctctgtgtgtctcaagcctggcccactgtgggtgctcaaatgagagtcctactccccataaaaacccagtggccgcctctgggtgtagctgcctctcatgatgcagtttgagcccgtgatgccaccttgtacaggaagctacacagtcctcggcctccatgcttaagggaaagttggcccaagtcatggtctgccaccggccacagcaccggtgaggagggaggagtgcattcagaaatgtttgggcacctaacagtttttacagcattctactttttgtcaattggttaaccagtaattcgctgtgaaccggaaggccccatttccaaaagcttacttagtgcaggaattctctgtgcaggccccagggagaaggggttccttctctggaagccagtcgtcttgtgtctggggcttgacctcgggtagtggtgccagggcagcgccctgcactctgcccagcatccagggactggccagatcccctccctgggctccctggccttggcatcagcctgggctcccaaactaggcccttcccaattcaaggccacgatgtgtgccttcaggacaccggggacactctgggcagcgtcctccggggcttcttcaccatccgcaagcgggagccaggcggccgcctgcccacctcctccacctgcttcaacctgctcaagctgcccaactacagcaagaagagcgtcctccgcgagaagctgcgctacgccatcagcatgaacacgggctttgaactctcctagctcctgtcccagccctgcctccagggctcctgggctgccagggaccttcagctcccagaggcagtgtggtcctgggaatgtgaccaacatgccaggtgacattggcccctagaccctctctatagccatgagactccttgtggcctcaagaaatttagacgcccacgacagcactacacagcatctccaggtgatgcccaaggcacagggctgcagaaaataaacctccagattccaccaacacgggtccattcttcctggtgatggcagaggggcttcttttagctagtttgatcttttgggagtctgtctttccttagccgtctgagtgagctgtgtatgaacaagtcccaggagttccaagagtctagagtggtttttgcagcatgggttgagtgtacaaagcctactgtgcgtgagatcctctccttccgtttctgaaatctcttactcaggtaaggcctcgccaagcctctatgcaccccacaaagtttctgcctccatgccgtccacagcgcctcttcccagacagccaggcccatctgctgcccagggaagcgcaggcgcctgctagggacgctatggacaccgtgagtccaaggcgctgctcctgccttgaagccacgcgctccacgccgcggccctcccattttctgcgtcctcagcgggctgagctgccagagagccttcccggacctattcccgtcctatgcattcacattggcatcctggtttgggggaagaaaaacaacggcccttagcagcagccccgtttccagaatgtgctgcctgttccccaaagcctgcttgtcccgcggaggacggctgcctttgaccctgcttatttgtctcactggttatctaatgaggaacaaacactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaacagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacagaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagca

SEQ ID NO: 453095 - DNA, 3978 bp, Homo sapiens
  misc_feature (3723)..(3723): n is a, c, g, or t
  misc_feature (3953)..(3953): n is a, c, g, or t
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagaggtctgtgactcctgccccccagtgtgcaacttctccactctccaacacctgcacttggatttttacatttgcattcagcatacctggtgtcctcctcagaaacacttttcataggaagagcttgatgcctgctgtcctcttcttccttcccctgccttgtctcacttgtgggtcaggtaaagggaggacagtggtgctgggatcccttgaatgctctacatttttggctgcaagggtaatccagtcttttgacatttaaactctggaaggagacctcagggcttgttccctcagattccttcttggttgatgtctagaatcatatttctagctctgtgtcctcaaacagccctttccactttgtaccttgttgtgccagatcatacctctagggaattgttgagaaagcctgattgctgtttaaaggtacaatggaagtcttgagtttgagaagtaatgttgactttgcccttccttctccctagtgctgtgatgggctgtttcctgatttggtttcatatgctcctcacaacaaccctgtgaggtggtccgttggcagaagctggtatgactggcagttgtctcgctagaggaaccttctacttcataccataattaaacggcttctaaaataatatgatgtctttaaattttaagtctggcattatttgtattagctgtttttttaactttattattaaagaatttctaaccataatatttagagaaagagtggtagagttaacctcgttacccaatactttcttccctttccttttataaaaacactgcatacggttttttgtttttttgtttttttgttttttttttaagagacagggttgccctgtcacccaggctggcctcaaggaatcttcctgcctcagcctcctgagctgggactgtaggtacaagccaccatgcctggctcacaatacagtttttttatctgaagcactcagtttacttttttgctcttttatgtacaaatgaatataaagttgatatcatcctctgaccaattaaaacattcttttcagatattgttaacccgtggcctggcaagaccccgtccttgtctatccaaaggcactttaacagcagctttttctctagcgttacggtgagtaagaaaccatagctgaggtgttggcatgttcttgaatgcttcctcctcttggtttttctttctctcgttactggtattaggtatagacttgcccattttgtcagaatttatgggaagcattgttcttaatgaaagtgagcacatttgtgactgctcaaactttttcttaatcttcagtcttgaatatttcttaatcttcagccctgaatattattgcagtgtgatctttggaaactattcaaaatgaatttcttttatctaaaagaggccaagatgcaatcatttttccttttgaagttttaattgacaaaacaaaaaacctaggagccaggagaagcccagcaaagggcagggtgagaggattaaggaaataatgtgaatacgcatgtaaaatgttagaatttggaggaccagagaagaggtgatatttgccttcacttagtttggagatgtcaggtactgaagaagctaagttaattccttatggaaattacacctgcaattctgagaattgccaaatgtaaaacactatgcttgttcataggtccagaacatgtttaaactgtcaaggggaacactagcttggggagatgttaataaaagatcctggaaggaagagtgtcatggtggaaccagcttggtgaaagctgcctgctctgcccccatctgtggatctacagtacaccttcatgctgagagctctgagaagtgctgctatgctagcaggaccccatgggcttatttaacccggggttggcccaaacgtatctgagcatggaatacccctgccttgttttttggatgccgttgatatcccatgaaatcattttccatggaaaacctatttggaaaatgatgggctagagcatgggttggccaaattttctggaaagagccggataaatatttcaactctatgggccatacagcctctgtcacaaccactctgccattgcatcttgaaagcagtcgtagattgtacatacacaaatgagcatgactgtgttccagtaaaactttatttacaaaaataggccatagtttataaacacctggtctagactgtgctttccactaaccactagccacagggggctgtttaaatgaaaattcatttaagttaaataaaatgaagaattcacttcctcagttgcattagccacatttcaaatgctcagcggccacatgtaactagtagcaattgtgtgggacagcacagatatagaaaacttccagcatcacagaaagttctgttggacaaggctgacctagagcaggtctgtccgatggaaacacagttagagccacatttaaaaagccaaaagaggccaggcacggcggcccatgcctgtaatcccngcactttgggagactgaggtgggcagatcattttgagctcaggagttcaagaccagtctgggcaacatggccaaaccttgtctctacaaaaaatacaaacattagctgggcatggtgccatgtgcctgtggttccagctactcaggagtctgaggtgggaggatcactggagccagggaagtcaaggctgcagcgagccgtgattgagcttctccagcctggatgacagngtgatacctggtctcaaaaaaaaaa

SEQ ID NO: 453096 - DNA, 1418 bp, Homo sapiens
  misc_feature (1234)..(1234): n is a, c, g, or t
  misc_feature (1253)..(1253): n is a, c, g, or t
  misc_feature (1257)..(1257): n is a, c, g, or t
  misc_feature (1262)..(1262): n is a, c, g, or t
  misc_feature (1265)..(1265): n is a, c, g, or t
  misc_feature (1291)..(1291): n is a, c, g, or t
  misc_feature (1300)..(1300): n is a, c, g, or t
  misc_feature (1319)..(1319): n is a, c, g, or t
  misc_feature (1356)..(1356): n is a, c, g, or t
  misc_feature (1358)..(1358): n is a, c, g, or t
  misc_feature (1418)..(1418): n is a, c, g, or t
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtgaaagtcttcgaccagcgatgaaccacatttgtgcaaatataatgggacatctcaaccagcatggattttattctgtgctgcagncgcctgccacgccgcctcntcantcgcngcntctactccctcgactctctcgcgtcntcaataatnctccctccaccacaccaanccctcctccacgcctgcctcccgcctcgcagacgctncnagccaccccgcacgccccccccgcctacgacgaaccccctcccccacaccataattaaan

SEQ ID NO: 453097 - DNA, 1535 bp, Homo sapiens
gaacaccgcggggcaagatggcggtagtgcgtcggctgctgccccgggtctggcagaactcgggtgttttgggctgagacagtggcagctgcggccccgaccccaagtgcggggacctccggcgaataaaggtcggcctgcgggtaggccggtagggcctgcggtccggcctgcgggagaactgggtcgtcagtcctccgagtggtggggctggggactttgagggagttggctctagggcacagtccctgcctggccaggtcggaggaacaagtgctgggatctggcgtgtgtgctccaggggctctttccgcggccctttccacctcttttcactttggggacggtaggcctttataaacggactaatgctgggtgatttgttcctgtggttgttgatgccgaggaaagactctgggccccaggactcacctaaactggagttcgaatactgttcgctcgctgtgtgaccttggaaaaaataacaagcttttctgaagtgagaagctgttctcagccacgagtcctgtgcaagatcactaatgattacctggcatttctgcgacacaggcaggtcctcagggtttgtgcaagtttgcaaacatgttcaccctgtctcagacctcgagagcatggttcatcgatagagcccgtcaggcacgagaagaaaggcttgtgcagaaggaacgggagcgggcagctgttgtgatccaggcccatgtccggagttttctctgtcggagtcgactgcagagagatatcaggagagagattgatgacttttttaaagcagatgaccctgagtccactaaaagaagtgcactttgtattttcaagattgccaggaaactgctgttcctattcagaatcaaagaggataatgagagatttgagaagttgtgtcgcagcatcctgagcagcatggatgctgagaatgagcctaaggtgtggtatgtgtccctggcttgttctaaggacctcaccctcctttggattcaacagatcaagaacattttgtggtactgctgtgattttctcaagcagctcaagcctgaaatcctgcaggactcccgactcatcaccctgtacctcacgatgcttgtcaccttcacagacacttcaacgtggaaaattcttcggggaaaaggtctgtgggacttgcttcaaaatgttctctaaccaacatttccatagagagctcagggaccttttttcctttgtaagaagcatttttgccacaagcctcagggaaggccctgagaccatacaaatgaggatgcccttggtgctgaccatcagactgcatcgcagtatccacaatccattcagcattgtgtgttgtactcaacccttctttgaatttacatttaaagtcatggttcttctgattttaatttttatagttcccacagtgccttagcctccaagtgattacattcacttaagccttgtcattttacttggaaaatcattaggttgtgaataattctattttgcccataaaatttgcattataaacttcttccttccctggt

SEQ ID NO: 453098 - DNA, 339 bp, Homo sapiens
tggtcctctaattctgtaggaatgaatcagatggttgtagccccttctgtttcttgaattatcctttgattcttctcagcttgaccatgaaattcatctttttcttattcttactgcctttcagatgtagttactctagagtagggcatgtaggtagggtcttagtaaaaggagaggaattatagatgtggcctttttcaaacccccaatgcatataggcatgtaaatcctactcataaatgcctgcaacaacctagatgtggattgcatatttattatggtaataatgtttagttctaaatttttcagtcacgaatctcttacatattgatatgtctg

SEQ ID NO: 453099 - DNA, 716 bp, Homo sapiens
agttaactagtcaagagataaataacaaccaaaaaaaaaaaaaaaaaaaaaacactatctcaagagggtatgtgtttatgagccaaaagccagcttggataaaagtagggacaaggtccctgcctctgtatcagatggtctgccgttgacggcacctctgagtacccaccagcaccactgggaaagcaggagttgctgtgctcggtcccttccttggaggctgccttccctgccttgtggatatcccagttctggagctttgtggtcattggcctcccaacagaggctcccttcttccctcacctttaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453100 - DNA, 2000 bp, Homo sapiens
gtggttaatagtttctatgaatcttgttattgttagcagcagctgcctgttactgaggcagttaccattgctgtacactgatgacatgatccatatgtctgagctgagccactgtcaccatcttagttcaggctgagggtgggtgaagggtgcccctcctgatgggcgggactgtgccttaggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453101 - DNA, 3441 bp, Homo sapiens
ctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453102 - DNA, 3214 bp, Homo sapiens
ctctcctagtacttcctgttctcggctaaccctggcgctgggccgggggctggagagtgaccgtggtctgagtgacctggggcggcgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453103 - DNA, 3487 bp, Homo sapiens
ctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453104 - DNA, 1292 bp, Homo sapiens
ccctgcccagttgttaattagaccctgatttcttagtggacacctggccactgcctcttccctagcctggcagctgtggcttctgaccccctcccctccaacccctcaccctccagatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453105 - DNA, 3415 bp, Homo sapiens
ctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggagggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453106 - DNA, 996 bp, Homo sapiens
aacttaaggggccttaaaagggttcgaaggcccccgcgcgtgggttttaatcggcagaagctgatgccggacccttatctgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453107 - DNA, 3812 bp, Homo sapiens
ctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaatgacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccagaaaaaaaaaaaaaaacaaaaagatagacagaaaaaaataacacagagaacagagctaataccacagaaagagacacaacacgcaagcaatgacagcacaaagaatacgcgaatatgagaaccaaggggcggggcaccatcatgaatcacccccgagcggcaacttaatcgtagtagactctcaccccgctgtgttatgttgaaaaaagaggtagtgcccaacataatgcacggagagcatatatatcaacaacagccaccccgtcacggtggggtgatggtatttaacaaaaaagtagcacgttggttggagagagacccactgctgtagcctgagaagattcttcggtggggagcgagccaccatatttatctggcggggggacaagacataggagggagaaaattctacgtg

SEQ ID NO: 453108 - DNA, 438 bp, Homo sapiens
agcaggcagtgtgggcacaggtgggttgttaatcttgttcgtccaggtgtctcagagtccagctatgttagacacactcagttaatattagccaacacaacaaatattctgctcccttttctccccagggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453109 - DNA, 393 bp, Homo sapiens
gggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcaggtaactggccttcccagctctttatcgtgtgttacctcaggcattctcttccctatcccatgttttccttcagttcctcccaactccctgtatttctgttgtgaacttcagccagccagtcaaagggataattctctctgccttcccagcagggggatgctttgctggcctctgcccagagtcaagtctggt

SEQ ID NO: 453110 - DNA, 3512 bp, Homo sapiens
ctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453111 - DNA, 1810 bp, Homo sapiens
ctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453112 - DNA, 1757 bp, Homo sapiens
ataggctaggtaagcctgggtgttaatcgcgtagagggatgtgggtgagctgtactgtagagtaggacctgggcgtgagtgccttttcctgttcatcgaattgccgtatagtccatggcatggatcgtcatggcagcgttgatagtactgctgtgtcatggcgtgtgtgaggaccagtcgaaggaagtgtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453113 - DNA, 1424 bp, Homo sapiens
ctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctaccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453114 - DNA, 631 bp, Homo sapiens
  misc_feature (28)..(28): n is a, c, g, or t
tctacaggatcttacaatacaccagcgntgctcaatgcctttacgccagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453115 - DNA, 386 bp, Homo sapiens
ctctatcactcggcagccgcctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 453116 - DNA, 2627 bp, Homo sapiens
ctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccgggtaagtccctccccacgatacctggtccaagaattactctattcttttggacccccatcctaccccagtctccatctctgatcctgtcttctgctcttcagttgcccatatacccctgaaggctcctgggagggggaagtcaggaacaggcttatctcctcccttttaaaacaatgttctattatggaaattttcaaacatgcaatagtagaaaaattgtactacactgtataacaaattcccatacccccctgcaacccctccacttccagtgtatttgtcatcaagctt

SEQ ID NO: 453117 - DNA, 1056 bp, Homo sapiens
caaaaaaaaaaaaaaaaatccccaactcactgctttttttgtttgtttctgtcgcctaggctggagtgcagtggcacgatctcagctcaccacagcctcgacctcccgggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaggtaggccttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtctttttcttggctagaagtctttcctcagtttttgttgactatcatacgctgatttgtgggtgacggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacctcccataaaaaaaaac

SEQ ID NO: 453118 - DNA, 294 bp, Homo sapiens
cggcacgaggccattcttatgttggagcggccgcaatcgtttcttggctagaagtctttcctcagtttttgttgactatcatacgctgatttgtgggtgacggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacctcccataaaaaaaaac

SEQ ID NO: 453119 - DNA, 653 bp, Homo sapiens
cctgcaggtcgaatttacaaggatcccacgatatcttgtgtatctgtactgtaattattttagaggtacatgtgatattagaataggagtatacatgagtaatgatcaaatcagcgtaaatgggatgtctatcaccgctaacacttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtctttttcttggctagaagtctttcctcagtttttgttgactatcatacgctgatttgtgggtgacggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacctcccataaaaaaaaac

SEQ ID NO: 453120 - DNA, 1045 bp, Homo sapiens
caaaaaaaaaaaaaaaaatccccaactcactgctttttttgtttgtttctgtcgcctaggctggagtgcagtggcacgatctcagctcaccacagcctcgacctcccgggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaggtaggccttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtctttccccccccagtctttcgtcagtgggggtttttattatacgcccccccctttttcccggccccccgctagagggcccgtttttggggggggtggggggcaccaaggagtcacacagggaacagaaaaagtgacagagaggctttttttaataatagcttgcgtgtttccgtagaaacaaaaaagaaaaattcatttgggccaaaagggaataaaataagttttttcaaaaacatcccaaaaaac

SEQ ID NO: 453121 - DNA, 1249 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaa

SEQ ID NO: 453122 - DNA, 754 bp, Homo sapiens
ccagacgttgaatatgtggggctattggtagaacttgactaaggttcccatgtggcacacgctactgacaagcgagaaacgtcctggctcttgccctcatcctggttctggaatcctcagttcaaggtaagactcaggagtcttgttccccagccatcttctctgtaagccctgtggtccatgcaagtcattatattcattttaaggcatagaatgtataatattgtgagaaaggaggcaaagaagaaggatttggggtcgctgaaccctttaatatgagttctgttaagtttggtaccaagaaaaattaaactctgtggcgtgtgcagtcttgtaaactcttacaatgattgaaatgtgctattttgggatgaaaatgtgaggtttataaattttaaaagctcaaaaaaggaatctagaaaatgactcctgtgcctgttgcatggaggagatggcacctttgactgttggggggtgtctgcctacccctaagtgtctacatcagccccaagttttagtgcgctgtgacggtgtcattgttattttaacactgggagacgttatattccaattggggtgaatctgactgtgtgtattttcttttctttttttttttttaaagataaacttggttcttactgaaaactccaattatggttagacatagttcatgtaaaacctctcagattttaaagagaaggccaaataatttggtatttgtgctcttgctcagagaagcatcatattcggaaat

SEQ ID NO: 453123 - DNA, 1360 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaaaaaaaaagtcaacacaaaacattttgggcgccgcagccgaaacattataacaacagttggcccggccaaagatgtacacatgaaggggccacaagacggtaaccagaggaa

SEQ ID NO: 453124 - DNA, 1107 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggtatcaggctataccccactcatcaagatttacgtttgtatattagtaactagtgcatcactaggacagc

SEQ ID NO: 453125 - DNA, 1107 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttattcaaagactccttttctcaccgtttgacttcttctctctcaaaccacaactacttacttcatttaatacaaccggcacgtcctcttatatttttccctctcacccaccccatgccagtcttcatacttctcctcattcctc

SEQ ID NO: 453126 - DNA, 1031 bp, Homo sapiens
  misc_feature (1004)..(1005): n is a, c, g, or t
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataatttgcttcccaagctactttaaaaatatagtctgannggccgcgatttagtagtagtagtagt

SEQ ID NO: 453127 - DNA, 1189 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaataaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaa

SEQ ID NO: 453128 - DNA, 1207 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaa

SEQ ID NO: 453129 - DNA, 795 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggtaagactcaggagtcttgttccccagccatcttctctgtaagccctgtggtccatgcaagtcattatattcattttaaggcatagaatgtataatattgtgagaaaggaggcaaagaagaaggatttggggtcgctgaaccctttaatatgagttctgttaagtttggtaccaagaaaaattaaactctgtggcgtgtgcagtcttgtaaactcttacaatgattgaaatgtgctattttgggatgaaaatgtgaggtttataaattttaaaagctcaaaaaaggaatctagaaaatgactcctgtgcctgttgcatggaggagatggcacctttgactgttggggggtgtctgcctacccctaagtgtctacatcagccccaagttttagtgcgctgtgacggtgtcattgttattttaacactgggagacgttatattccaattggggtgaatctgactgtgtgtattttcttttctttttttttttttaaagataaacttggttcttactgaaaactccaattatggttagacatagttcatgtaaaacctctcagattttaaagagaaggccaaataatttggtatttgtgctcttgctcagagaagcatcatattcggaaat

SEQ ID NO: 453130 - DNA, 544 bp, Homo sapiens
aaacattgaataattgggaagcttttaaatctcttaatttgagcaactagatggctgtatttatctccttatattaaaaaaactattataattatctttcccacatatcaaactccactggtttttttcccatttttctttcatacttcaaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttt

SEQ ID NO: 453131 - DNA, 477 bp, Homo sapiens
  misc_feature (42)..(42): n is a, c, g, or t
taagaagcgcagttagcctttagagctagataagcacgacangggctttttttaataaaatgcacgcgcccctcccgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacgtctactcaccttcccaagaatcctcccctacacaccacacacttgtctgccacccgtctatcaaacgataccatactccctagctcacccct

SEQ ID NO: 453132 - DNA, 1594 bp, Homo sapiens
  misc_feature (1261)..(1261): n is a, c, g, or t
  misc_feature (1266)..(1266): n is a, c, g, or t
  misc_feature (1268)..(1270): n is a, c, g, or t
  misc_feature (1272)..(1272): n is a, c, g, or t
  misc_feature (1277)..(1277): n is a, c, g, or t
  misc_feature (1285)..(1285): n is a, c, g, or t
  misc_feature (1289)..(1289): n is a, c, g, or t
  misc_feature (1292)..(1292): n is a, c, g, or t
  misc_feature (1304)..(1305): n is a, c, g, or t
  misc_feature (1313)..(1313): n is a, c, g, or t
  misc_feature (1324)..(1324): n is a, c, g, or t
  misc_feature (1332)..(1332): n is a, c, g, or t
  misc_feature (1334)..(1335): n is a, c, g, or t
  misc_feature (1341)..(1341): n is a, c, g, or t
  misc_feature (1355)..(1355): n is a, c, g, or t
  misc_feature (1359)..(1360): n is a, c, g, or t
  misc_feature (1374)..(1374): n is a, c, g, or t
  misc_feature (1389)..(1389): n is a, c, g, or t
  misc_feature (1399)..(1399): n is a, c, g, or t
  misc_feature (1402)..(1402): n is a, c, g, or t
  misc_feature (1406)..(1407): n is a, c, g, or t
  misc_feature (1411)..(1412): n is a, c, g, or t
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaaaaaaaaaaaaanaaaanannncntgtcngccggggnaagnttntgtgcaagctgnnaggatggnttggcccgaanggttgctntnnccgccncgctagctgtgagntgannaaaaccctgggctnacagaccccaaaagnctgtggcttnagncctnngttnngaccaaacattaaaaggatcgttttggtttgtttttaaagaaaggtaagattggctttgttctttatgagcaaattggaaatagccctttttctgtttttccttgctcatttcggtatggggaaagaaatctgtacatggattgggaatgtaaaagaacatttcctgcatttaaacaagttt

SEQ ID NO: 453133 - DNA, 1164 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttatccccatttttgccaaaatggcgaaataaatatgaaggaaatcaacgtaatgtccttaccaacaggtgcgacacccgcaaggccccttgaaaattgaaagggtttaatcttttgtggaaatcccgggttaacacatttgggaaaaaagttctatttttaaacaaagggggcaaacacggtaaaatggcttataaacaaa

SEQ ID NO: 453134 - DNA, 1231 bp, Homo sapiens
  misc_feature (292)..(292): n is a, c, g, or t
  misc_feature (295)..(295): n is a, c, g, or t
gagagcaatacgttggtcacgaggcacaagctactcaagttgccgtcggcatgtccgggctctagcacacattctgcttcagtaatgctcaggattcactggtcattctacgaacacgaccacggccgggataccagatgcggttgctgacatgccacaatccaagatagataattctcgtggcgatacactgacctggaatcaatacaaggagccaagtgctatacgacagactacttgtaccagtgctgaattaccgaccacacgaatccgccgtctgaggactgacctnttnccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaa

SEQ ID NO: 453135 - DNA, 1194 bp, Homo sapiens
cattttctaaaagggacagagagcaccctgctgacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaa

SEQ ID NO: 453136 - DNA, 147 bp, Homo sapiens
atttctagataatgtttccttttgtaaccttggttagtcctcttgttctttatatccatgaacaattagaatgtttaatgctacaagaaacataacagatggattttatttagcctcttccaggtgttatgagtgcttctcattgtt

SEQ ID NO: 453137 - DNA, 218 bp, Homo sapiens
ccctgccttcagagagctgaaaagggtccctcggtcttttatttcagggctttgcatgcgctctattgtcccttgccactccccactctcatcaggccaagtggaggactggccagagggcctgcacatgcaaactccagtccctgccttcagagagctgaaaagggtccctcggtcttttatttcaggcccaggcccgcagatacatgcacgagagt

SEQ ID NO: 453138 - DNA, 1959 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgacgtcagacgctgaactatgtggcttttctgttttgaagaaaaaataacttctaaagtattaggagggaaagagaatgataaaataattctgccaaacaaaggagacacaggagcactggaacagctgggacagatggcggcttgaaactgaagcaggccagctattacactagacagaaatggactaaatctcaggtaagagacaagagttttaactgtagcacattaa

SEQ ID NO: 453139 - DNA, 1561 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453140 - DNA, 3105 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaaggagtgatgagggctgcttgtggctagggtgcagggtcatcctaagggaatggcagggtgtccctaagcagccttgagggactgtgaaaagagaactgagcaaggagggaggatctggactcctcactctggtccttggctgttacctgggacaggtcacttcctctctctggatccgtgtttcttctgtaaatgatagaggctgggctagtggtagttaagatctagtgctcattccattctctgcatgagatagatgggtattcttgtagttcagaatcttgaccagctcagtggctcatgcctgtaatcccagcactttgggagtccaaggcgggtggatcacttgaggtcaggagttcgagaccagcatggccaatatggtgaaaccccgtctctactaaaaatacaaaaattagctgggcgtggtggcgggtgcctgtaatcccagctactcgggaggctgaggcacaagaatcacttgaacccgggaggcggaggtttcagtgggctgagattgtgccactgcactccagcctgggcgacagagtgagattccgtctcaaaaaacaaaacaaaacaaaacaaaatctgtctacttggggatagcaggcctggatgggctagcaggatgtcccacccctagaggagtcaggtgtgtgggtggtggtggtgtagggtctgaagaacactgcatagctatctacatgagcttcccttacggacacttgagcttgtgccctttgcttaaatcagcttccctctttctttcaggatggctggcattggcatcagggaaggtaggaaggctttactcttctggtgtggggtggggaggggagatgttgaagccaccacccccttcggaatagggaggaaggagaaagagcccaaacatcccattaggtgggaacattcccattcattagatgcctcttccccagtgggaacttctgtcagccccaggtgagattgcagctggtgatttattgagaaacttccaggttgagtaggcttcattcagggcatgtctctcccccaggccccatcttcatacacttccgctaagatgcccacaattcatcccccttcatgtgcagcttgaaaaaccctgacattgttgctccctgccgggcatacctgccattgccactgcccatctctgtgatgaggaattcaacaccagatctctggcagctcttgagggattggccagtggcattctcaggggtgctgtctagttttcccagagccccgccaaggtcctggccaccgtggcagagcggggaggttcccccactctaaagcctactccttctctctctagccctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453141 - DNA, 1578 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggacctgggtcatgttctgtgggtaccggctc

SEQ ID NO: 453142 - DNA, 1785 bp, Homo sapiens
ggagtggggaagttgaggggagtgcctttacatcctgctggtcatcgtggccacttcagtctgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaaggtacgtgccctggaggaggccaatgctgacctggaggtgaagatccatgactggtaccagaagcagaccccagccagcccagaatgcgactacagccaatacttcaagaccattgaagagctccgggacaaggttgctactggctggaatgttctgtagatccatggctgtgtccaaggtgtgcaggaggcagtgaccatgagttgtccacagtggggctggtggagtgtctctgagagagctattgtcagagctggctgcaccccactgccccactctcctgggcaaccaattcccacaggcaatactgcctccttggtctttcgtgccctggagataaggaaggcagctcctcaggtgtctcaaggaggctggatgggacaaaacaagaaatggacactgaaaatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453143 - DNA, 2577 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaaggagtgatgagggctgcttgtggctagggtgcagggtcatcctaagggaatggcagggtgtccctaagcagccttgagggactgtgaaaagagaactgagcaaggagggaggatctggactcctcactctggtccttggctgttacctgggacaggtcacttcctctctctggatccgtgtttcttctgtaaatgatagaggctgggctagtggtagttaagatctagtgctcattccattctctgcatgagatagatgggtattcttgtagttcagaatcttgaccagctcagtggctcatgcctgtaatcccagcactttgggagtccaaggcgggtggatcacttgaggtcaggagttcgagaccagcatggccaatatggtgaaaccccgtctctactaaaaatacaaaaattagctgggcgtggtggcgggtgcctgtaatcccagctactcgggaggctgaggcacaagaatcacttgaacccgggaggcggaggtttcagtgggctgagattgtgccactgcactccagcctgggcgacagagtgagattccgtctcaaaaaacaaaacaaaacaaaacaaaatctgtctacttggggatagcaggcctggatgggctagcaggatgtcccacccctagaggagtcaggtgtgtgggtggtggtggtgtagggtctgaagaacactgcatagctatctacatgagcttcccttacggacacttgagcttgtgccctttgcttaaatcagcttccctctttctttcaggatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453144 - DNA, 1896 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtgcgctcccccgtctctctcctcttcctgcattgcccactttacttggccttctcctggctctgactcaggcagccaagacccctcccacttccttctttggcctccctctcctcaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453145 - DNA, 1538 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaaggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453146 - DNA, 1106 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagagtctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453147 - DNA, 1035 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatctggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453148 - DNA, 889 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagctgtattgtgtaacaagctcatttgtacagtgtctgttcatgtaataaagaattacttttccttttgcaaataaaaaaaaaagta

SEQ ID NO: 453149 - DNA, 448 bp, Homo sapiens
ccggacctgtgctggggaagatgggcaggatgccaggatggctgcattggcatcaggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453150 - DNA, 502 bp, Homo sapiens
ctggggccaggtccagagggctgagccacacctccaagtggcactgcccacaggtatcaggtgtccctggaaaggtgtccctgagctggtggcagagaaaagggctctcctgagtgttcaactccccgtctgtgtgaagcaatgccttggtcttcaagatctccggtgtcttccagcctgcctgccagtctcccttctcttcccttccacagcattcaggcacatagagccttctgcagcggcccctccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggagga

SEQ ID NO: 453151 - DNA, 499 bp, Homo sapiens
cctgggcaaccaattcccacaggcaatactgcctccttggtctttcgtgccctggagataaggaaggcagctcctcaggtgtctcaaggaggctggatgggacaaaacaagaaatggacactgaaagtgaggctggactttgcccaccccagaagccgtacagatttttgttggtggtgtcagaggggtgattgtcagtgaggggtgattttcaatgaggggctggccttgggtgcagagcagagagcagcaggggagagagaggagtcctctagacaccgactctgtctcctgcagaatcatggccaccaccatcgacaactcccgggtcatcctggagatcgacaatgccaggctggctgcggacgacttcaggctcaagtgcgctcccccgtctctctcctcttcctgcattgcccactttacttggccttctcctggctctgactcaggcagccaagacccctcccacttccttctttggcctccctctcctcag

SEQ ID NO: 453152 - DNA, 1778 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453153 - DNA, 1512 bp, Homo sapiens
ggagtggggaagttgaggggagtgcctttacatcctgctggtcatcgtggccacttcagtctgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453154 - DNA, 1720 bp, Homo sapiens
ggagtggggaagttgaggggagtgcctttacatcctgctggtcatcgtggccacttcagtctgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaagcattcaggcacatagagccttctgcagcggcccctccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453155 - DNA, 1615 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtcccttttcagctctggtcgacgcggccgcgaat

SEQ ID NO: 453156 - DNA, 1220 bp, Homo sapiens
ccacagccaatgcgataagcagctctagacatgaaagctcgggcagatctggcaacaatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453157 - DNA, 2569 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaaggagtgatgagggctgcttgtggctagggtgcagggtcatcctaagggaatggcagggtgtccctaagcagccttgagggactgtgaaaagagaactgagcaaggagggaggatctggactcctcactctggtccttggctgttacctgggacaggtcacttcctctctctggatccgtgtttcttctgtaaatgatagaggctgggctagtggtagttaagatctagtgctcattccattctctgcatgagatagatgggtattcttgtagttcagaatcttgaccagctcagtggctcatgcctgtaatcccagcactttgggagtccaaggcgggtggatcacttgaggtcaggagttcgagaccagcatggccaatatggtgaaaccccgtctctactaaaaatacaaaaattagctgggcgtggtggcgggtgcctgtaatcccagctactcgggaggctgaggcacaagaatcacttgaacccgggaggcggaggtttcagtgggctgagattgtgccactgcactccagcctgggcgacagagtgagattccgtctcaaaaaacaaaacaaaacaaaacaaaatctgtctacttggggatagcaggcctggatgggctagcaggatgtcccacccctagaggagtcaggtgtgtgggtggtggtggtgtagggtctgaagaacactgcatagctatctacatgagcttcccttacggacacttgagcttgtgccctttgcttaaatcagcttccctctttctttcaggatggctggcattggcatcagggaaggtaggaaggctttactcttctggtgtggggtggggaggggagatgttgaagccaccacccccttcggaatagggaggaaggagaaagagcccaaacatcccattaggtgggaacattcccattcattagatgcctcttccccagtgggaacttctgtcagccccaggtgagattgcagctggtgatttattgagaaacttccaggttgagtaggcttcattcagggcatgtctctcccccaggccccatcttcatacacttccgctaagatgcccacaattcatcccccttcatgtgcagcttgaaaaaccctgacattgttgctccctgccgggcatacctgccattgggccagcgggtgccatgggtgcccaggcggg

SEQ ID NO: 453158 - DNA, 1407 bp, Homo sapiens
gaagaggccccaaaagaagtcccacttcttcctggtggagaggtgagggctgcaggcccaaccctatgagtgatgggggcaagtgagggacactagttccacgcccgcatgctgccaaatgtactcagcaccctgctaaggaggctggagaccccatcacggccatggcaatcccgaaggaggagctgtttcaaggtacgtgccctggaggaggccaatgctgacctggaggtgaagatccatgactggtaccagaagcagaccccagccagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453159 - DNA, 743 bp, Homo sapiens
catctctggccagcacacgggtcaggtccacacccggtgctgcgtacatctccacattgacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaagta

SEQ ID NO: 453160 - DNA, 3457 bp, Homo sapiens
agactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggcaaaaataaggaggaaattatattattttaatatccaaatttaaaggtttggaaaattttgaatagttaatattagaacttatgttgctgttttttatatttcaaggattgagtattctgcattaatccaatactattccaacaaagagattctggaagtttttaaaaaatgataccctgttttatattttgaatgtagagagactctgagagagagaatgttctgagttatactttttattttttaagatttatttttaagaataaaacattgacctgaacattttagcctaaccaagggacttaagtggtaaagacttgcattatgtcttcatgtgaactgatccgttcattatatattatgggaaaaatcaaagaaagttttttatagagatatgaagatattatttagagagatatttattatgacattttttaaaaacatatttttctattttcaaaatattatttctaggctatatttttattggtgctgtgcaaatgattttgcagttttgaaaatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaataaatagaaacactgataaggaagaaaaaagaactaatgtctatgtcttctgtagtcagcaaaagtctggatccattttctattttgtgttccattggcacactttgtgttcaaatttcagtgcagtcctttcaaaatactcgctaagggttgcctaagtgtctgccttactttctgattgtccttttctgagagcatggttaagaacatcttaaccatatagctgttgaaaaaatctgtttattaaataacaagttcacttctgtttatgttttgagtttagaaaatttgacttgaaaatttagattattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaattgggcagttctgaaattctgtttggtcagttctagatggtacgtcatgtgaatgcaaccaagcactgtagttgaaattgtgttatgccactactcatatgttgtcttaggtactacgcataatgttaatagctgagatgttaaagaatttgaagtctaaaatataaaagatgaatatacccatattaatcctatgttaagatgctctggaaataaaggccttattcccttacacatgcgatttttgtaagataatatatacacagtatattttaaatgtttgtgtgggtggtctgtgtagttactccccatacaacaaagctgacaaaatttttaatttacacaatgtattctgcattttcaaatgtttatgttgtgtatatagcaaagaaattatcttactgatatgcgttgaccaaatcccatggagaaaagacatctcatttgaggttccccttcctctcatgtgtttgattttttggaaggtgatacagtatgtgggtaaccatgcaaatgtttatgaataactttactgaagtgattccatccgtattctgttctaatacttggagaatgaccttcatatttatatattttatttctttgtttcaactatccagtgataattcaggaaatgtttccttttttttttttttttacaaaaactttttatttgtaaaatgtttgtaataatgtaaaggtgaacatgttcaataaaaatcatatattaaaagtt

SEQ ID NO: 453161 - DNA, 3394 bp, Homo sapiens
agactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggcaaaaataaggaggaaattatattattttaatatccaaatttaaaggtttggaaaattttgaatagttaatattagaacttatgttgctgttttttatatttcaaggattgagtattctgcattaatccaatactattccaacaaagagattctggaagtttttaaaaaatgataccctgttttatattttgaatgtagagagactctgagagagagaatgttctgagttatactttttattttttaagatttatttttaagaataaaacattgacctgaacattttagcctaaccaagggacttaagtggtaaagacttgcattatgtcttcatgtgaactgatccgttcattatatattatgggaaaaatcaaagaaagttttttatagagatatgaagatattatttagagagatatttattatgacattttttaaaaacatatttttctattttcaaaatattatttctaggctatatttttattggtgctgtgcaaatgattttgcagttttgaaaatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaataaatagaaacactgataaggaagaaaaaagaactaatgtctatgtcttctgtagtcagcaaaagtctggatccattttctattttgtgttccattggcacactttgtgttcaaatttcagtgcagtcctttcaaaatactcgctaagggttgcctaagtgtctgccttactttctgattgtccttttctgagagcatggttaagaacatcttaaccatatagctgttgaaaaaatctgtttattaaataacaagttcacttctgtttatgttttgagtttagaaaatttgacttgaaaatttagattattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaacactgtagttgaaattgtgttatgccactactcatatgttgtcttaggtactacgcataatgttaatagctgagatgttaaagaatttgaagtctaaaatataaaagatgaatatacccatattaatcctatgttaagatgctctggaaataaaggccttattcccttacacatgcgatttttgtaagataatatatacacagtatattttaaatgtttgtgtgggtggtctgtgtagttactccccatacaacaaagctgacaaaatttttaatttacacaatgtattctgcattttcaaatgtttatgttgtgtatatagcaaagaaattatcttactgatatgcgttgaccaaatcccatggagaaaagacatctcatttgaggttccccttcctctcatgtgtttgattttttggaaggtgatacagtatgtgggtaaccatgcaaatgtttatgaataactttactgaagtgattccatccgtattctgttctaatacttggagaatgaccttcatatttatatattttatttctttgtttcaactatccagtgataattcaggaaatgtttccttttttttttttttttacaaaaactttttatttgtaaaatgtttgtaataatgtaaaggtgaacatgttcaataaaaatcatatattaaaagtt

SEQ ID NO: 453162 - DNA, 3401 bp, Homo sapiens
agactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggcaaaaataaggaggaaattatattattttaatatccaaatttaaaggtttggaaaattttgaatagttaatattagaacttatgttgctgttttttatatttcaaggattgagtattctgcattaatccaatactattccaacaaagagattctggaagtttttaaaaaatgataccctgttttatattttgaatgtagagagactctgagagagagaatgttctgagttatactttttattttttaagatttatttttaagaataaaacattgacctgaacattttagcctaaccaagggacttaagtggtaaagacttgcattatgtcttcatgtgaactgatccgttcattatatattatgggaaaaatcaaagaaagttttttatagagatatgaagatattatttagagagatatttattatgacattttttaaaaacatatttttctattttcaaaatattatttctaggctatatttttattggtgctgtgcaaatgattttgcagttttgaaaatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaataaatagaaacactgataaggaagaaaaaagaactaatgtctatgtcttctgtagtcagcaaaagtctggatccattttctattttgtgttccattggcacactttgtgttcaaatttcagtgcagtcctttcaaaatactcgctaagggttgcctaagtgtctgccttactttctgattgtccttttctgagagcatggttaagaacatcttaaccatatagctgttgaaaaaatctgtttattaaataacaagttcacttctgtttatgttttgagtttagaaaatttgacttgaaaatttagattattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaattgggcagttctgaaattctgtttggtcagttctagatggtacgtcatgtgaatgcaaccaagcactgtagttgaaattgtgttatgccactactcatatgttgtcttaggtactacgcataatgttaatagctgagatgttaaagaatttgaagtctaaaatataaaagatgaatatacccatattaatcctatgttaagatgctctggaaaattttaaatgtttgtgtgggtggtctgtgtagttactccccatacaacaaagctgacaaaatttttaatttacacaatgtattctgcattttcaaatgtttatgttgtgtatatagcaaagaaattatcttactgatatgcgttgaccaaatcccatggagaaaagacatctcatttgaggttccccttcctctcatgtgtttgattttttggaaggtgatacagtatgtgggtaaccatgcaaatgtttatgaataactttactgaagtgattccatccgtattctgttctaatacttggagaatgaccttcatatttatatattttatttctttgtttcaactatccagtgataattcaggaaatgtttccttttttttttttttttacaaaaactttttatttgtaaaatgtttgtaataatgtaaaggtgaacatgttcaataaaaatcatatattaaaagtt

SEQ ID NO: 453163 - DNA, 1139 bp, Homo sapiens
ctggctaacacggtgaaaccccatctctactaaaaatacaaaaattagctgggcatggtggcgggcgcctatagtctcagctacttgggaggctgaggcaggagaatggtgtgaacctgggaggtggagcttgcagtgagccgagatggcaccactgggcgacagagcgagactccgcccccaccccccataaaaaggggaatgccgttcttggtctgggatggccttgctgtggtacactccagggagcacgggccagggtcagggttctggctctggagcccctttggtcccatcagctacagtcctacagttttccaactgcaggggctacctctgaggagcaggatgatgaggctgagcctcgtctggtctgtcagtggccccaccgtgtcagactccagggtagattggtcagagagcaggggaaggacattagaaagtctggtgtggcccggggtttagtggggtgaactgcagaggaacagaccaagagtgagcttgtgggccgggatcctccccgcattagcagcagccccacaagttccagaaaggagcagccagggagcaggggaaagctgggatcacaggcctaggcaggccctatggttctcacactgtaggaggactggccaaggggcagcatgatggctctgaaggccctttagtcccataggcaggtggcctactctgggcagattgcaaaaggggctggctagggaggtggattcatgcctggtcaccttgtctacctgccacagccctattgtgaatagactctaatagggaccagccagtcgcatcaacagcagccccactgtggtcagactcaaggagggcctggctggaagcaggatgatggtctgtgcattctccccacaggtggggaacgccaagcacaacgtgcatgtcatgaacatctccgctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctga

SEQ ID NO: 453164 - DNA, 2184 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggtgggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453165 - DNA, 1841 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453166 - DNA, 1720 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctga

SEQ ID NO: 453167 - DNA, 1881 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453168 - DNA, 1847 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaaggctgccgcgggcggacacgccagaggaggaggccggggaatggccgcggtgtggcagcaagtcttagcagtggacgcgagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453169 - DNA, 2150 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggtgggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453170 - DNA, 1829 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtcaggctccaggacacccacacagtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453171 - DNA, 2777 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggtgggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagactttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctga

SEQ ID NO: 453172 - DNA, 1445 bp, Homo sapiens
  misc_feature (1242)..(1242): n is a, c, g, or t
  misc_feature (1248)..(1248): n is a, c, g, or t
  misc_feature (1257)..(1257): n is a, c, g, or t
  misc_feature (1259)..(1259): n is a, c, g, or t
  misc_feature (1264)..(1264): n is a, c, g, or t
  misc_feature (1270)..(1270): n is a, c, g, or t
  misc_feature (1276)..(1276): n is a, c, g, or t
  misc_feature (1278)..(1278): n is a, c, g, or t
  misc_feature (1281)..(1282): n is a, c, g, or t
  misc_feature (1296)..(1296): n is a, c, g, or t
  misc_feature (1303)..(1303): n is a, c, g, or t
  misc_feature (1307)..(1307): n is a, c, g, or t
  misc_feature (1314)..(1314): n is a, c, g, or t
  misc_feature (1322)..(1322): n is a, c, g, or t
  misc_feature (1345)..(1345): n is a, c, g, or t
  misc_feature (1353)..(1353): n is a, c, g, or t
  misc_feature (1360)..(1360): n is a, c, g, or t
  misc_feature (1367)..(1368): n is a, c, g, or t
  misc_feature (1376)..(1376): n is a, c, g, or t
  misc_feature (1385)..(1385): n is a, c, g, or t
  misc_feature (1430)..(1430): n is a, c, g, or t
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagcccgcgggggngcgggnggcggcggngngggcngggggnagccgngnggnncgggagccgggcanggggggngganggggggnggcaagangggggggggcggacagggggggngacaacgngggggcncggcagnngaagagangcggccgcnagcgaggagagggggagcaggcgggggcggaggagggggggggcncgcggcagggccggc

SEQ ID NO: 453173 - DNA, 1301 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggcacgcctgcccaagccaaccgcccgctcgcgcatcagccgacgccttgcgccccagccctcagcccgcctcctgtccagcctctcacccccggcatcctcctgctcactcg

SEQ ID NO: 453174 - DNA, 1387 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtcaggctccaggacacccacacatgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453175 - DNA, 1680 bp, Homo sapiens
ctggctaacacggtgaaaccccatctctactaaaaatacaaaaattagctgggcatggtggcgggcgcctatagtctcagctacttgggaggctgaggcaggagaatggtgtgaacctgggaggtggagcttgcagtgagccgagatggcaccactgggcgacagagcgagactccgcccccaccccccataaaaaggggaatgccgttcttggtctgggatggccttgctgtggtacactccagggagcacgggccagggtcagggttctggctctggagcccctttggtcccatcagctacagtcctacagttttccaactgcaggggctacctctgaggagcaggatgatgaggctgagcctcgtctggtctgtcagtggccccaccgtgtcagactccagggtagattggtcagagagcaggggaaggacattagaaagtctggtgtggcccggggtttagtggggtgaactgcagaggaacagaccaagagtgagcttgtgggccgggatcctccccgcattagcagcagccccacaagttccagaaaggagcagccagggagcaggggaaagctgggatcacaggcctaggcaggccctatggttctcacactgtaggaggactggccaaggggcagcatgatggctctgaaggccctttagtcccataggcaggtggcctactctgggcagattgcaaaaggggctggctagggaggtggattcatgcctggtcaccttgtctacctgccacagccctattgtgaatagactctaatagggaccagccagtcgcatcaacagcagccccactgtggtcagactcaaggagggcctggctggaagcaggatgatggtctgtgcattctccccacaggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453176 - DNA, 1684 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggtgggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagactttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacagcaccctgcagcatgtgcccacgtcagcagcagcagcacgaaaggatcctgctagatcac

SEQ ID NO: 453177 - DNA, 345 bp, Homo sapiens
accgagactcgtagtggagatagtttgctgtgagccgagggggtaggagggggcatgtggggagggccgggtcttgctggcacctcccagccacccgctcctaatggcgtgaatgtggtcggattgctttgctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctga

SEQ ID NO: 453178 - DNA, 1805 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453179 - DNA, 1807 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453180 - DNA, 2862 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggtgggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagactttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453181 - DNA, 1914 bp, Homo sapiens
ctatctaccaaggagcctgttgtgagacagttttctccccacctcctgaggttctggtggggtttgaggctttctacccctcacctctgggctatagaactgcttagctgcagcatgaaattagctcctcagcaacaaggtgtcctgccacctggtgtgtggtcatctcgcccctttcatttcggtgttgcccggcacaagggacatgaaccagaatctgtggatgttcttgctttcgtggtccacgctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453182 - DNA, 1748 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgaaacactacgagcacatataatacagggg

SEQ ID NO: 453183 - DNA, 1830 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccgtggcagtgtcttctctttcctctttgatatggccacagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacagggtggtagacaacgaggggaccctgcagctgaagagaagcttccccatcgagcagagctcacatcctgtgcgcagcatcttctgtcccctcatgtccttccgccagggggcctgcgtggtgaccgggccgtgcaggacttgtgcgttcacttctttgctgtggagcggcggcaaggccgctgtcaacagctgcgggcccagtgcactggctggtgtcgctcactggagagagctatggcccttgagcacgggcgtgtccctggctggagacgggaccaacatcgtccgctttgccgcgctgtgcttcatcccgacatttatcacgcccgttgcaaaagccctggctcgcgtccaaccaaggggcgccacaacctctgaggccacagcccctatgttcatgcacaccgaattcacacgccgaccaggcatacactcgtacacctgcggtgtccccctacatcctagcttgccactgtgctctgccgaccgtcatgctgaag

SEQ ID NO: 453184 - DNA, 1505 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgacctgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453185 - DNA, 1196 bp, Homo sapiens
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtggggaacgccaagcacaacgtgcatgtcatgaacatctccctccatcccacccctcttactccagcctcgtgttgtaaataaagtttcggtggtcatgctgagggccggctcccagctctgccggggacggacagggcagagggcagcgggcagctccaggaacacggtggaacggggaaaaaaaac

SEQ ID NO: 453186 - DNA, 2720 bp, Homo sapiens
  misc_feature (16)..(16): n is a, c, g, or t
  misc_feature (18)..(18): n is a, c, g, or t
  misc_feature (21)..(21): n is a, c, g, or t
  misc_feature (39)..(39): n is a, c, g, or t
  misc_feature (52)..(52): n is a, c, g, or t
  misc_feature (2627)..(2627): n is a, c, g, or t
  misc_feature (2713)..(2713): n is a, c, g, or t
cggcgcaacaaatttntncancctggagacggaaactancttcggcttcggnaaacccacgcgtgcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggtgggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagactttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaacaggtcagtaaacatatagcaagccctgtctttagtatctgctgagcagggggagggcaggaacagcagaactcgtgaggaagccactgcagtagtacaagtgggcagcggtggtggtggcaggggacacagtgagaagtgatctgactctaggtagattttcagggctccacacctcaaaggttctcgggctttttgcaagatgcacccaccctgaccctctccatttgcaggactttgaggatgatcctcgggccctgggggcccgtgggcaccgtcgttctgtcagcagaggctcctaccagctgcaggcgcagatgaaccgtgccgtctatgaggacaggccccctggcagcgtggtgcccacgtcagcagcagaggcaagtcgggccatggccggggacacgtcactgagcgagaactatgcctttgcgggcatgtatcatgtttttgaccagcacgtggatgaggcaggtgagccagtgggtagcgggttccatcaccaaggtttgcccaaactgtgacaaccaaccaaggcatccttttctgaatccaaggcccctggcacactccaaaggaggaatgaccatccataaagccttttgtagactgaaaatccctctgcaaagtggtcagtgcttcgtctactggaaagggcctcagaagcctaagagagagccctttgcagcaggctgcctgggttcctgagtcacttggaagagttcaaagcctttgctgatgataaatccccttgcagagggcagagtggctacagtgtcaagggttttgcaaattgccaagaccttgattataaagtgttcgctaagacaggaactttttcatgttgcagaagacttttgcaatctgcaaaggagctgctaagacttagggagctttggcagagggtcttcaggggttacagttccctttgtcagccaaggaaagccctntgctgaggccactgttcctcatgcagtgggccccagccccaggcacacacgtcagagccttttagagagaaaagtgcccagtgagnggaattc

SEQ ID NO: 453187 - DNA, 584 bp, Homo sapiens
  misc_feature (343)..(343): n is a, c, g, or t
  misc_feature (345)..(345): n is a, c, g, or t
  misc_feature (349)..(352): n is a, c, g, or t
  misc_feature (356)..(356): n is a, c, g, or t
  misc_feature (360)..(360): n is a, c, g, or t
  misc_feature (365)..(366): n is a, c, g, or t
  misc_feature (369)..(371): n is a, c, g, or t
  misc_feature (375)..(376): n is a, c, g, or t
  misc_feature (378)..(381): n is a, c, g, or t
  misc_feature (383)..(383): n is a, c, g, or t
  misc_feature (385)..(387): n is a, c, g, or t
  misc_feature (389)..(391): n is a, c, g, or t
  misc_feature (395)..(395): n is a, c, g, or t
  misc_feature (400)..(400): n is a, c, g, or t
  misc_feature (402)..(403): n is a, c, g, or t
  misc_feature (405)..(407): n is a, c, g, or t
  misc_feature (412)..(413): n is a, c, g, or t
  misc_feature (419)..(419): n is a, c, g, or t
  misc_feature (422)..(423): n is a, c, g, or t
  misc_feature (425)..(427): n is a, c, g, or t
  misc_feature (429)..(429): n is a, c, g, or t
  misc_feature (436)..(437): n is a, c, g, or t
  misc_feature (440)..(440): n is a, c, g, or t
  misc_feature (443)..(443): n is a, c, g, or t
  misc_feature (445)..(445): n is a, c, g, or t
  misc_feature (452)..(452): n is a, c, g, or t
  misc_feature (482)..(483): n is a, c, g, or t
  misc_feature (519)..(519): n is a, c, g, or t
  misc_feature (572)..(572): n is a, c, g, or t
tgggctcggcagttctttctgatagcaggcagccatcttgcctggagcctgagaaagggaggagagacagaaggaaccggcgacagtggtctcagggccgctccggggggcctcaagaaccggaggcagccccggaggctgccgcgggcggacacgccagaggaggaggccggggaatggccgcggtgtggcagcaagtcttagcagtggacgcgaggtacaacgcgtaccgcacaccaacgtttccacagtttcggacgcagtatatccgccggcgcagccagctgctgcgggagaatgccaaggctgggcaccccccagcgctgcgtcggcagtacctgantnatcnnnntcancatnatttnnaannncacnntnnnntntnnnannnattnattangnnannntatannaacatnaanntnnngnttatagnngantantntataccncatttattacttatattattaacctctttnncgtttttccgatttcaccttctaactttcaacatantctccaaccatcgatcattctcataataaccgtttcgcttctattattacatnccccccttcatc

SEQ ID NO: 453188 - DNA, 103 bp, Homo sapiens
cgattgcttagtgtgtacagggtctcttttgggggtgatgaaaatgtgctggaactatatagaggtggcggttacataacattgttaatgtgccaaatgccac

SEQ ID NO: 453189 - DNA, 1211 bp, Homo sapiens
cgcgcttccagtcgccccggcaacagccgcctccctcgcgtcccccactccccctctgtctctccaaggaaaactaggcccctgcgcggccaacgcccaggatccgcaagctgcgcgcccacgagctccaccagcccattggagaaaagttactgttcagtccctgaaggcttgtgccataaaagagtgggagacattcccagggagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatacta

SEQ ID NO: 453190 - DNA, 1129 bp, Homo sapiens
cgcgcttccagtcgccccggcaacagccgcctccctcgcgtcccccactccccctctgtctctccaaggaaaactaggcccctgcgcggccaacgcccaggatccgcaagctgcgcgcccacgagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatacta

SEQ ID NO: 453191 - DNA, 847 bp, Homo sapiens
ttgaggataataaacactttggtgtccaccctccacctcctttcattttgtaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacatattcacaggtgcacaaaaccgatcagtgagatgatacgtgttaatggctgtagaaaagtggaaaggaacatgaaaatgcacttctgttgtaaaagtaaaaatggcggttgtccagtaacttcaggattacatttgtcatggggcaagggatgtgcgacgaagagagaagaccagtctgaaatggctccagttctgctggcatgtacctgtgttctgggtggttgctgacaagccagaaatgaggcattcatggcatacatcaagtttgtgctttccctcggttgtgctacaattattcattttggcaaaatagcagaaaatataatcagaaagat

SEQ ID NO: 453192 - DNA, 369 bp, Homo sapiens
atatttatatggtcattttcatagactttacttcctatagggaaataagtaattgaaccatgcaggatcttttgacccacttaatcaaacctaagtggatccctccttttcagaccacaaagttatagcccaggaaccaacgtcatatagataggttgcatgaaatcaggcatggtcctgggaagaggcagttccttgggagctgcctcacaaaccatagaatagccacaaatatcacacagccatactgatcagacgtttgcactgtgattcttctttcctagtttcagcacccatttggactttcacaatcagagatggcagcggtaaaggtaagatttttatttttttattttttttttgagctcg

SEQ ID NO: 453193 - DNA, 1693 bp, Homo sapiens
cgcgcttccagtcgccccggcaacagccgcctccctcgcgtcccccactccccctctgtctctccaaggaaaactaggcccctgcgcggccaacgcccaggatccgcaagctgcgcgcccacgagctccaccagcccattggagaaaagttactgttcagtccctgaaggcttgtgccataaaagagtgggagacattcccagggaggtgaggaatgaaagatcgaattaaagaccattaaagaccaaagggcatctaaatctgcagcaaccatcagctctcttttctttgagagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatactatactggttttttatgttgttggtaacagttcaattcattaacgttcttgcctagagatactgcctggtgttttgcttttttatcttttcttgtctttaacctgtctgaactacacaaatgcctttaaaaaaccagatatcctctctgactctagctccattagcccccactaaaaatgagccaagtgtgtagtgagacaaataccactacctgtagtggagagggatgcatgttctataaagggccagagagtgaatatctttggcactgcaagccacacggtcagtgttgtgactactcaaccctccctttgtagtgtgaaagcagctgtagacagtaagtaaacaaatgggtgtggctgtgttctaataaaactttatttataaaaacaggc

SEQ ID NO: 453194 - DNA, 1222 bp, Homo sapiens
atcttctgtgatagggttattattgcatgtacagagagattccttggaaccgcatatgactcaatctatctcactcagatttctcaccataccttcacttattttgctgcagtgtccagcagatctccttgaaacactccaccagcccattggagaaaagttactgttcagtccctgaaggcttgtgccataaaagagtgggagacattcccagggagtttcagcacccatttggactttcacaatcagagatggcagcggtaaaggcatcaacatcgaaagctaccaggccttggtattctcatccggtatatgcaagatactggcaacattatcatcaagcaatggcttggatgcaaagccatcacaatgcctacaggaaggccgtggaatcctgtttcaatcttccatggtacttaccttctgcgcttcttccccaaagctcttacgataatgaggctgcgtatcctcagtccttctatgaccatcatgtggcctggcaggactacccctgcagttcttcacatttcagaagatctgggcagcatccacgttacagcagtaggatccaggcatccacaaaagaagaccaagctttgtccaaagaggaagagatggagactgagtcagatgcagaggtagaatgtgacctgagcaatatggaaatcactgaagagctccgccagtactttgcagagaccgagaggcatagagaagaacgacggcggcagcagcagctggatgcagagcgcctggacagctatgtgaacgctgaccacgacctgtactgcaacacccgccggtcggtagaagccccaactgagaggcctggtgagcggcgccaggccgagatgaagcgtttgtacggggacagtgctgccaagatccaagccatggaggccgcggtgcagctgagctttgacaagcactgtgaccgaaagcagcccaagtactggccggtcatccccctgaagttctgagctcagggcacagggtacccagcctctccttcttccttttgggtacacgctctttatctctccttctgtacatttcttagggaaaggggactttgtactggggtacaggcatgttcaccacagtcccagtgggcctgtcacggggtggatgtactatgccagccacttggaggtctgcaggacatgttctgttgccaacatgataaattttctcctgacataaaataattttgcatatacta

SEQ ID NO: 453195 - DNA, 189 bp, Homo sapiens
gcctttgagttttctcctatcaaggaaggggagacacacatgatgctcacgtgtctgtctatctcaggagactggggttaccctctggggccggtccctgggaggatctgctatgggacaccagctggaggctggctaggcagtgaggcaacaacccaattccttcaactcctcgggccctgcttggat

SEQ ID NO: 453196 - DNA, 1768 bp, Homo sapiens
  misc_feature (1514)..(1514): n is a, c, g, or t
ggaggagggctgccctgaagaaagatggcctccgcgagaggaggaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggcaaggatggaagtttggaatcccttcctggatgtcatcgggtttggggtctctttgttgtgggatgagatttgggagttctatgttgaaatgagtgagcccggaaaacggttcatgtctcagttccccttggaaaggtgtagaagttaagagtttgagatgcgtggagcagttaataccatcaaagctttgtggtgggttctgaaaatcggtccagtgagtatgtagggtcatgggattttagaggtggacatgatcaaatccatcttagagatcaacacatctcactcatttttttatttttttctttattttgagacggagtttcactcttcttacccgggctggagtgcaatggcatgatctcagctcactgcaacctctgcctcccggttgaagcaattatcctgcctcagcctcccgggtagctgggattacagggtcctgccaccatgcccagctaatttttgtatttttagtagagatggggttttgccaacttggccaggctggtctcgaactcctgatctcaggtgatgtgcctgcctcagcttcccgaagtgctgggattacaggcgtgagccaccatgcctggccacatctcactcattttgtgaaagaggaaacatgtagagtcctaagtttgttgaacctactgttgtaaactgcctttttttttttttctttgagtcagggtctcactctgttgtccaggctggagtgcagtgacgccatctcagctcactacagcctccaccttcccggttcaagcgattctcctgcctcagcctcccaagtagctgtgactacaggcatgtgccaccacagccggctaatttttgtatttctagtagagatggggtttcctcacattggccaggctggtctcgaactcctgacctcaagtgatctgcctacctcagcctcccagagtgctaggattacaggcntgagccaccttgcccagccgcaaacagcttttatggttgaactcactgatgagcagcttgggctttggcagcagacacatctggatttgagtcctaacactctcccagctccgtagtcttaggaaagttgcctgacctgagactcagattctgacttacaaagtgttgcttgtaacaatccagggagctctgtctgtcaagtgcataacatgtacctggtgcatgttacaaataaatgttaactgttgcctttt

SEQ ID NO: 453197 - DNA, 2871 bp, Homo sapiens
tggaggctgggggatggcagtagggccgggctaggactggggctggagcggagtttgggggctggggctcaggagcgggggctggggctggggctggggctgggggatggcactagggccaggccggggtaggggtcacatcccaggagggccgggcctgggcagagctgagtccgcgggggccggaccccggaagccaagcggccggcctgcaggatgaggcctggctcctcggccatgaccacagacgtgccagacttaagtcggagacctgaggagccaggctgcagcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453198 - DNA, 2590 bp, Homo sapiens
ggtttggtttcataaacacggcatttaagatgattttctttgcaagatgctgtccaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453199 - DNA, 2403 bp, Homo sapiens
cgccggtgttaagggagtgaggatgtaaaccgtgtgggggggcaaatgggactttcgacatgcttcgaaacatcgagcttgttacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453200 - DNA, 3020 bp, Homo sapiens
ccctggccataggctccactctgtcagtcagccacacatttattgagtaccagttgtgtgcaaagcactgttgggcatgaaaagcattaacccagtgaatgaggaggagcttgggttggggacggagccccagaattacatggcagaccagaagggaatcagctcagtagaagacacgcatgggctcgtgggcgacgcagtgtgtgctgtgtcatctggggctgggaggaagtgtcctgggtcaggagttccaggagcccaggaggagtggacgggtcagtgcagagccagcccgcattcaggggagaaaacacggccaaggccaggcggtgcccacatgctctgcagggtctgggcactgtggcagcggcagcaggcttccctgttgctagtccagctgctgaaactccagggagagtcaaaaagttcccaaatacagaggcgtggctggtagtccttcccgggaattcttcttgcttcccgcctgtggaactctgccttccccactctgcctctctgcttgttcctgggccccaggacctctttcccatcttcgatctcttaagtcataccttgggaggcctcccccagcccgccgtgtaaagagggctgtcacagcttctgctgtcacagaagcattacaatgtgcaggtgcctgttaacatctgccttccccactgatctggagctccacaagggagagggcacacccagtaggtatgtgtgggatggataggagggtggatgacacccagtagatgtgtatgggatggataggagggtggatgacacccagtaggtgtgtatgggatggatgggagggtgggtgacccctagtagatgtggggggggtgggtgggtgacccccagtaggtgtgtgtggcatggataggtgacccccagtagacgtttgtgggacggatgggagggtaggtaagtgacccccaggaggcgtctatagggcaggtgggtggatgtggatgaacagcaccttgtttcttcttcccaggtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453201 - DNA, 1740 bp, Homo sapiens
  misc_feature (1)..(1): n is a, c, g, or t
nacgccaagctggcacgaggggtggaagtgtggaaggactgagtgttgtttcttccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453202 - DNA, 1777 bp, Homo sapiens
attgccaggcgtgatctctagaggtcgatctgtggcgtgtgcttgcttgggactggacgttccgattcataccgtcgttcacatggccagaccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453203 - DNA, 1064 bp, Homo sapiens
ggaggagggctgccctgaagaaagatggcctccgcgagaggaggaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtgagtagggccatccaccgccagtcccatctggttcctaatcctgcaccctaagtgttaaaagcatcagggtcactgtcagcatcacctgggagctgggtagaaagaaatgcagattctcagtccccttccgagtcatgaggggaatctttgctgatgaactccaggtaacttttatgaacactaatgtttgaca

SEQ ID NO: 453204 - DNA, 2147 bp, Homo sapiens
ggaggagggctgccctgaagaaagatggcctccgcgagaggaggaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgc

SEQ ID NO: 453205 - DNA, 2879 bp, Homo sapiens
ggaggagggctgccctgaagaaagatggcctccgcgagaggaggaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453206 - DNA, 3046 bp, Homo sapiens
ggaggagggctgccctgaagaaagatggcctccgcgagaggaggaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggaggcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcagcaatgctggagcagaaaggatcacagatgtggctttggatttctggaggagtggaaagcagagggaagacatcaagctcaaagacattgaacacgcgttgtctgtgtcggttttcaataacaagaacagtgagtagggccatccaccgccagtcccatctggttcctaatcctgcaccctaagtgttaaaagcatcagggtcactgtcagcatcacctgggagctgggtagaaagaaatgcagattctcagtccccttccgagtcatgaggggaatctttgctgatgaactccaggtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453207 - DNA, 3073 bp, Homo sapiens
ccctggccataggctccactctgtcagtcagccacacatttattgagtaccagttgtgtgcaaagcactgttgggcatgaaaagcattaacccagtgaatgaggaggagcttgggttggggacggagccccagaattacatggcagaccagaagggaatcagctcagtagaagacacgcatgggctcgtgggcgacgcagtgtgtgctgtgtcatctggggctgggaggaagtgtcctgggtcaggagttccaggagcccaggaggagtggacgggtcagtgcagagccagcccgcattcaggggagaaaacacggccaaggccaggccttcacggggagcccagcgtgggctgcacatctgcactctccaggctagttttggtgcccacatgctctgcagggtctgggcactgtggcagcggcagcaggcttccctgttgctagtccagctgctgaaactccagggagagtcaaaaagttcccaaatacagaggcgtggctggtagtccttcccgggaattcttcttgcttcccgcctgtggaactctgccttccccactctgcctctctgcttgttcctgggccccaggacctctttcccatcttcgatctcttaagtcataccttgggaggcctcccccagcccgccgtgtaaagagggctgtcacagcttctgctgtcacagaagcattacaatgtgcaggtgcctgttaacatctgccttccccactgatctggagctccacaagggagagggcacacccagtaggtatgtgtgggatggataggagggtggatgacacccagtagatgtgtatgggatggataggagggtggatgacacccagtaggtgtgtatgggatggatgggagggtgggtgacccctagtagatgtggggggggtgggtgggtgacccccagtaggtgtgtgtggcatggataggtgacccccagtagacgtttgtgggacggatgggagggtaggtaagtgacccccaggaggcgtctatagggcaggtgggtggatgtggatgaacagcaccttgtttcttcttcccaggtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453208 - DNA, 2789 bp, Homo sapiens
aggtcgggtcagaagttccagaagcccagaaggagttgaacgggtcaggtcagagccagccgtcattcagggaagaaaacacgtcccagggccaaggggtgcccacatgctctgcagggtctgggcactgtggcagcggcagcaggcttccctgttgctagtccagctgctgaaactccagggagagtcaaaaagttcccaaatacagaggcgtggctggtagtccttcccgggaattcttcttgcttcccgcctgtggaactctgccttccccactctgcctctctgcttgttcctgggccccaggacctctttcccatcttcgatctcttaagtcataccttgggaggcctcccccagcccgccgtgtaaagagggctgtcacagcttctgctgtcacagaagcattacaatgtgcaggtgcctgttaacatctgccttccccactgatctggagctccacaagggagagggcacacccagtaggtatgtgtgggatggataggagggtggatgacacccagtagatgtgtatgggatggataggagggtggatgacacccagtaggtgtgtatgggatggatgggagggtgggtgacccctagtagatgtggggggggtgggtgggtgacccccagtaggtgtgtgtggcatggataggtgacccccagtagacgtttgtgggacggatgggagggtaggtaagtgacccccaggaggcgtctatagggcaggtgggtggatgtggatgaacagcaccttgtttcttcttcccaggtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatagcccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctggggaagtcgccctccattgtgggggttcttggagctcctgacacccagccacggagtttcaagtacagcttgagatgccagcagggaacagtgccctaggattaagggtaaggcacaccttatttttatccaacatgcctgtgtcccagcacgtgggcagtgctcccatgggtgcggctgctgcagagagcactgcaggggccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtct

SEQ ID NO: 453209 - DNA, 595 bp, Homo sapiens
taagggataagatagaacaaaatccttttgagctctgtgcttttttgcataacttggtctaaaaaaaaagcaaaggttttaacatcttccttatctatgtgtttttgtcattttcataggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453210 - DNA, 7035 bp, Homo sapiens
caaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453211 - DNA, 6983 bp, Homo sapiens
caaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453212 - DNA, 6942 bp, Homo sapiens
caaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacacatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaagtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453213 - DNA, 6930 bp, Homo sapiens
caaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacacatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453214 - DNA, 3502 bp, Homo sapiens
caaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaatcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacacatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453215 - DNA, 1672 bp, Homo sapiens
ttttcagtattaccgatacctgctccaatcttctgttttaaaaagttggctttttctgacattgctctgtcaggaaaaggggtagggcacagcctgtttactgccaagtgggggtcaaagtccaggttccccactccattgccacctaagaagggattgttccttggtggctgggtgggaagggaagttccccatttggcctccactgatactgcaggggcaggagcttcattaggggctggagatgaaagccctaaatccctacatggccttttctgacacaaccccagtgagggtgtagggtgcctctttagcctcaggagcatagaagtctaggctccccattcagcctttgctgttgtgggttggggaggggcctcaggtttttctgtggtgtttgactaaaggacagaagtcagtgtccaccagttttctatcatatctcgctatgctgccctttactggtactttggttagagaaagcagattttatttgggctttttcagtctgtactcattggtgtttccaggttgccggcttcttcatctctaagtctgggatttatgaggcaaaaagaaaattcaagacactgatcaccattttgttccttccgagaaccctagccagtctgtcttctgagctcttttcagggtcttatgtttctctgagctataatgtccaaagtttttagttgtacttagcaggaggaatagggcaaagtacatatatacaatcttcctggaactggaattatccccaagtatattttataaccaaattgatttagtttggaccccatgaaaatgtagtattacaatattaaattagatcaaaattttaatataaagtcactttatagatcattgttacataactaaactttcctcttttcttctagtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453216 - DNA, 388 bp, Homo sapiens
atcaaacatgacctgtgtgcaagaaaggggataggaggtggttggcagttgaccaaacacagacctgaagcccagatttcatcatcaaggactggcctagtagctgaggcccatgcctagactcctgactacaacacaggtcctccaaggatctggttttccactggattaaactcacttgagaaattgctgggtttttaaaaaattcagaataaatctttttcttcccttgagtttaggttactgggagcccagattagcaagattaaacaatggtggatcttataatgcttggagtgtagaaaaacttgcagcagaatttgcctctaaaccttggatccaggtttgtcttaatagactgataatatttactgctatcgtaataata

SEQ ID NO: 453217 - DNA, 6981 bp, Homo sapiens
caaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacacatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453218 - DNA, 7202 bp, Homo sapiens
caaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacacatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaat

SEQ ID NO: 453219 - DNA, 6932 bp, Homo sapiens
caaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacacatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcaatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453220 - DNA, 2646 bp, Homo sapiens
tccggcactaggcaagatctcccactcctctgagactatcccaatcgctctcatcgtccatttccctaaccttcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacacatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaaga

SEQ ID NO: 453221 - DNA, 2346 bp, Homo sapiens
agcggactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacggaacacgttcgggttttggttttgtttcgttcacctctgtctagatgcaacttttgttcctcctcccccaccccagcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggtggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccaggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagccacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagaaaacttctggaacaaatcaaacagatcagaccagacaaacacaaggctcagactggcaggaaccgaaacagggggggcggccgaacaaaacccc

SEQ ID NO: 453222 - DNA, 2293 bp, Homo sapiens
agcagctggacaagcgggcctcaggccagagcttcacctccgatgtccccgtactggtagacgggtattggggtgcggctgtgtgtagaagcaggagcagatgagcgacagcaccgacagctccttcatcttctccttgtaggcggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacggaacacgttcgggttttggttttgtttcgttcacctctgtctagatgcaacttttgttcctcctcccccaccccagcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggtggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccaggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagccacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagaaaacttctggaacaaatcaaacagatcagaccagacaaacacaaggctcagactggcaggaaccgaaacagggggggcggccgaacaaaacccc

SEQ ID NO: 453223 - DNA, 2269 bp, Homo sapiens
  misc_feature (2201)..(2201): n is a, c, g, or t
  misc_feature (2250)..(2250): n is a, c, g, or t
agcggactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacggaacacgttcgggttttggttttgtttcgttcacctctgtctagatgcaacttttgttcctcctcccccaccccagcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggtggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccaggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagccacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcaaggcctggaaatggcaggtctccagcaggtccccgaggtanaaaatctgtcggattggccgttcttcttgatgtgcctggtcgatcatgnacttgcacagggtgaagtc

SEQ ID NO: 453224 - DNA, 2177 bp, Homo sapiens
gtgtgcagtggcggcagggtatggcgggggccctgggcgcagccaggaccgcgggacccgcgcgcgaggcagggacgggggcgggggcggcggatcgcgaccccctggccctgccccgaccacaggccggatggcaggcgagggttcccagggcagcgcccgggggtcccggcgcccaccgaggcctgggcaggtggaggcgccagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacggaacacgttcgggttttggttttgtttcgttcacctctgtctagatgcaacttttgttcctcctcccccaccccagcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggtggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccaggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagccacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagaaaacttctggaacaaatcaaacagatcagaccagacaaacacaaggctcagactggcaggaaccgaaacagggggggcggccgaacaaaacccc

SEQ ID NO: 453225 - DNA, 3170 bp, Homo sapiens
  misc_feature (246)..(246): n is a, c, g, or t
  misc_feature (276)..(276): n is a, c, g, or t
  misc_feature (278)..(279): n is a, c, g, or t
  misc_feature (301)..(301): n is a, c, g, or t
  misc_feature (340)..(340): n is a, c, g, or t
  misc_feature (354)..(354): n is a, c, g, or t
  misc_feature (380)..(380): n is a, c, g, or t
  misc_feature (435)..(437): n is a, c, g, or t
  misc_feature (448)..(450): n is a, c, g, or t
  misc_feature (559)..(559): n is a, c, g, or t
  misc_feature (564)..(564): n is a, c, g, or t
  misc_feature (657)..(658): n is a, c, g, or t
  misc_feature (684)..(684): n is a, c, g, or t
  misc_feature (698)..(699): n is a, c, g, or t
  misc_feature (724)..(724): n is a, c, g, or t
  misc_feature (727)..(728): n is a, c, g, or t
  misc_feature (766)..(766): n is a, c, g, or t
  misc_feature (1736)..(1736): n is a, c, g, or t
attatacccattgttagctgactggattaaagcacatgatagtttaccttttaacagcataatgcaatattagaaatagttgaagaaattggaaggagtttcagaaatgtagctgagtttctcctgggcttaagggactttatagctcatgttcaaatgcaccactgtctctctgaattacagatgatctgtttttctaacaatacgacctgacgattttttttttttttaagagacagggtctcnctctgttgcccagactggagtgtagtggcncnntcttggctcactgcagcctcgncctcctgggctcaagggatcctcttgcctcaccctcccnggtagctgggactncaggtgtgtgctaccatacttggctnattttttaattttttgtagagatggagtctcgctgtattgcccaggctggtctcnnnctcctggcctnnngtgatcctcctgccctggcctcccagcaaattttttaaaataaattggctgggcacggtggctcccacctgtaatcccagcactttgggaggccgaggtgggcggatcncctgnggtcaggaattcgagaccagcctgaccaacatggagaaaccccatctctactaaaaatacaaaattagccgggtgtggtggtgcatgcctgtnntcccagctattcgggaggctgaggcnggagaatcgcttgnncctgggaggtggaggttgtggtgancanngattgctccattgcactccagcctgggcaacaagagcnaaactctgtcaaaaaaaaaaaaaaattctcctggataataaggctctttgaaaggaggattactcattgttttacgtaggaatatatgatgagtattatttagcaagactgttgctaaagaatatctgatgagctgaaaacattcttagtaaattgaataaatgtttaagggaaaaaatacgtagtatttatatttcattgtttcaacttgagaccatttcagatcacttcggaagtaatttaattcatcggagtatttgtaatatatgtttctaaaaaagtttagttctaaagatcagagaaaaagcatgacacaaagcgttttgactattttatgaatatgtgaattgaaagagaatgtacataatcatgtagtttccgttggcattggccggtttgtaatttcacaagagtcagatgaggtcatctacctgcagtatgtgaaggtgaatgtaaagtcatgtgactggacatgatgaagatgaagagggactctcgtttctttctgtttaagccaacacagctcagagtccttataagaaactgaaagaagcattatcgtcagtggaagcttttgaaaaacactacttagtaagtattaacaagtgttcaatgtctgttctgtgaatacctgtctctagaaggctttgctacatggcctgttgagttgggaaggaactggtgtggggggccccttcttgttggttttttttagtttctttggtacctggggagttgtggacaaaacatggagtagttcatcaaatgtgtattagtgcccatggtaccatgctaggcatggaatcatctttgaatatttaccgttttgttcaaattgggtttgctcacacagaaattataagagaggctagtgaatacttttctttgtaaaaaggagtaatttggacttgggcagagctattgtatttgattttgaaagacttaaattagcaaaactttaaaaaacggngtaggcagaagtgtggtgggtcagcgtcattcccgggtcatgggcaacttgagcgtttggtctgcccgtaatggctgtacctcttatacacacaagtatgaaaaatacccagcatgtcacccacgtgcagaaagtccttggaaaagttagatgttttggatgagtttgtgggtttcttttattattatgcttcataatttatacacaggttaccaattttgcttatatattacagaaaaattcacaaaaatagatgcaaaggaaaaaataatgttacattattagcaatgtcttctgcgggctgggcatggtggctcacgcctgtaattcagcactttgggaggctgaggcaggtggatcacttgaggtcaggagtttgagaccagcctagccaacatggtgaaatcctgtctctgctaaagatacaaaaaattagccgggcctggtggcgcctgtagtcccagctacttgggaagctgaggcacaagaatcacttcaacctatgaggcggaggttgcagtgagctgagatctcaccgctgtgctccagcctgggcgatggagcaagactctgtctcaaaacaaaaacccaacaatgtcttttgtgtgagctttaggtgaataaatgtagtatttgtccatcattaaaagttcaagtacataattgtgtttttacttccccacaggatttgtcccatgccaccattgaaatgtatacaagcattgggaggattcgatctgctaagtttgttggaaaagatctggcagagttttacatgtaattgattttgtacttttctttgaattctaaacatacaaataacacgagaagatttgttatatatggagttagtataaagtgcacataaatttgtagactgaaaagtgtagattctcttacccagtcctcataatttttttttcagtttcttctgaaaaccagatggagagattttctgcttgttactcttaataactgttattggtctttgaggttcttttatttaattaaatatatacatttttgtaactaagtttaattaaagaattataagacagtataatggtgagtaaattggcatatagattcttacatattttgttatatagcatttctctaattttatcaagtattaagaggactgaaaaacctcaaggccattgatgtaaagctactgcatgtgtcaggttcatgaaagagggatgatctagggatgactggaagaaggtgtgtacaaagactgcagggtttccattccagctccagctttgaagtttgattccagaaaaactcaaaatttagcgtatttctggtgtgtttcataaaatcagactatcaaagagaagaaaccccagtgggtcatgtggttaccatttcagagtactcaaaggagatacaagctataaggaaaaagatgcttgttttcattttcta

SEQ ID NO: 453226 - DNA, 1315 bp, Homo sapiens
  misc_feature (246)..(246): n is a, c, g, or t
  misc_feature (276)..(276): n is a, c, g, or t
  misc_feature (278)..(279): n is a, c, g, or t
  misc_feature (301)..(301): n is a, c, g, or t
  misc_feature (340)..(340): n is a, c, g, or t
  misc_feature (354)..(354): n is a, c, g, or t
  misc_feature (380)..(380): n is a, c, g, or t
  misc_feature (435)..(437): n is a, c, g, or t
  misc_feature (448)..(450): n is a, c, g, or t
  misc_feature (559)..(559): n is a, c, g, or t
  misc_feature (564)..(564): n is a, c, g, or t
  misc_feature (657)..(658): n is a, c, g, or t
  misc_feature (684)..(684): n is a, c, g, or t
  misc_feature (698)..(699): n is a, c, g, or t
  misc_feature (724)..(724): n is a, c, g, or t
  misc_feature (727)..(728): n is a, c, g, or t
  misc_feature (766)..(766): n is a, c, g, or t
  misc_feature (1283)..(1283): n is a, c, g, or t
attatacccattgttagctgactggattaaagcacatgatagtttaccttttaacagcataatgcaatattagaaatagttgaagaaattggaaggagtttcagaaatgtagctgagtttctcctgggcttaagggactttatagctcatgttcaaatgcaccactgtctctctgaattacagatgatctgtttttctaacaatacgacctgacgattttttttttttttaagagacagggtctcnctctgttgcccagactggagtgtagtggcncnntcttggctcactgcagcctcgncctcctgggctcaagggatcctcttgcctcaccctcccnggtagctgggactncaggtgtgtgctaccatacttggctnattttttaattttttgtagagatggagtctcgctgtattgcccaggctggtctcnnnctcctggcctnnngtgatcctcctgccctggcctcccagcaaattttttaaaataaattggctgggcacggtggctcccacctgtaatcccagcactttgggaggccgaggtgggcggatcncctgnggtcaggaattcgagaccagcctgaccaacatggagaaaccccatctctactaaaaatacaaaattagccgggtgtggtggtgcatgcctgtnntcccagctattcgggaggctgaggcnggagaatcgcttgnncctgggaggtggaggttgtggtgancanngattgctccattgcactccagcctgggcaacaagagcnaaactctgtcaaaaaaaaaaaaaaattctcctggataataaggctctttgaaaggaggattactcattgttttacgtaggaatatatgatgagtattatttagcaagactgttgctaaagaatatctgatgagctgaaaacattcttagtaaattgaataaatgtttaagggaaaaaatacgtagtatttatatttcattgtttcaacttgagaccatttcagatcacttcggaagtaatttaattcatcggagtatttgtaatatatgtttctaaaaaagtttagttctaaagatcagagaaaaagcatgacacaaagcgttttgactattttatgaatatgtgaattgaaagagaatgtacataatcatgtagtttccgttggcattggccggtttgtaatttcacaagagtcagatgaggtcattcaccttcacatactgcaggtagatgacctcatctgactcttgtgaaattacaaaccgccaatccaaccggaacctacatggattattgnattggaaaaggaagggggaaccttccttccgg

SEQ ID NO: 453227 - DNA, 7002 bp, Homo sapiens
aggccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccggggatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacagccaacacagctcagagtccttataagaaactgaaagaagcattatcgtcagtggaagcttttgaaaaacactacttagatttgtcccatgccaccattgaaatgtatacaagcattgggaggattcgatctgctaagtttgttggaaaagatctggcagagttttacatgaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctgatagccttctggcaggcattcctcagagagtcaagttcactgtcactaccggccattatacgataaagaatggagacagcctgcagcttagcaatgccgaagccatgctcatcctgtgccaggcggagagcagggctgtggtctactccaacacgagagaacagtcttctgaggccgcgctccggattcagtcctccgacaaggtcacgagcatcagtctgcctgttgcgcctgcgtaccacgtgatcgaatttgaactggaagttctctctttaccttcagccccagcactcggaggggagagtgacatgctggggatggcagagccccacaggaagcataaggacaaacagagaactggccgctgcatggttaccacagaccacaaagtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgtttgattttcttgtatctggttctactcccaggatgaaattatccaactacatatatatttagaggaagaaagtgaaggggaaatttaaaatgtttacggcgcttaattgcctggaaatgaaatgaaatcaaatttatcagtttttttccccctaattacccaaaagatcttttgcaaactatgttacatgaatgcttctgcctctttaagacaaagaagaatgtcacccaaaattgtcatttttttcttaatgttcatcataaaagtcctaaaagagtaactgtaattggatgtttattgtttttatctaaagtaaggtgtatgtgtttgagacaagctggttttgttgataaagagatgttaaataattgtgaagccagatatgcaatgtgtatctaaaaagcaaggaatttgcagccgttttacaaatatctgtggaacatgtaaatactgtcaaatggaaaataaaataagttataatttttgtgaatttcatgggatgtcctatgattggaaaaattataactcttctgattctaatgtggaaattgttgtatttaatctgaaaatgactttacctacaacagttccattgtcagcacagcctaggagggtcagattcctgtattaattactcttagtggagatgccagatatcccatacagaattagcagagaaaatacacacaggcttctattcaaattttctttagtgcttaaaattaagttttaaaatgaaatcagacactgcaggtttgtatataaaatgaaaagctatactactttttataaaagggcaaactgggctgatgtaaatgttttactttcaactgtgttctttaaaataaatcctacctggtttttaaattttatttttcatgaaaatgctcctttctctacatttattcatcctatatacatcaggctgtaagaccccccccagtcatcattaatacaatgtgttgggattctgtgactggaaaaggtgacaagttggtgactttgacactgcaggtattccattttcatggtttactatgaaaagtcatttttcatattatgtaatatattgttagattaaaaccattgtattaagactttaaaatgtaagcattgtaattctgaaaatacacattttaagaagaaaaaaaaaaagtcgacgcggccgcgaatttaatagtagta

SEQ ID NO: 453228 - DNA, 7018 bp, Homo sapiens
aggccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccggggatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacagccaacacagctcagagtccttataagaaactgaaagaagcattatcgtcagtggaagcttttgaaaaacactacttagatttgtcccatgccaccattgaaatgtatacaagcattgggaggattcgatctgctaagtttgttggaaaagatctggcagagttttacatgaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctgatagccttctggcaggcattcctcagagagtcaagttcactgtcactaccggccattatacgataaagaatggagacagcctgcagcttagcaatgccgaagccatgctcatcctgtgccaggcggagagcagggctgtggtctactccaacacgagagaacagtcttctgaggccgcgctccggattcagtcctccgacaaggtcacgagcatcagtctgcctgttgcgcctgcgtaccacgtgatcgaatttgaactggaagttctctctttaccttcagccccagcactcggaggggagagtgacatgctggggatggcagagccccacaggaagcataaggacaaacagagaactggccgctgcatggttaccacagaccacaaagtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgtttgattttcttgtatctggttctactcccaggatgaaattatccaactacatatatatttagaggaagaaagtgaaggggaaatttaaaatgtttacggcgcttaattgcctggaaatgaaatgaaatcaaatttatcagtttttttccccctaattacccaaaagatcttttgcaaactatgttacatgaatgcttctgcctctttaagacaaagaagaatgtcacccaaaattgtcatttttttcttaatgttcatcataaaagtcctaaaagagtaactgtaattggatgtttattgtttttatctaaagtaaggtgtatgtgtttgagacaagctggttttgttgataaagagatgttaaataattgtgaagccagatatgcaatgtgtatctaaaaagcaaggaatttgcagccgttttacaaatatctgtggaacatgtaaatactgtcaaatggaaaataaaataagttataatttttgtgaatttcatgggatgtcctatgattggaaaaattataactcttctgattctaatgtggaaattgttgtatttaatctgaaaatgactttacctacaacagttccattgtcagcacagcctaggagggtcagattcctgtattaattactcttagtggagatgccagatatcccatacagaattagcagagaaaatacacacaggcttctattcaaattttctttagtgcttaaaattaagttttaaaatgaaatcagacactgcaggtttgtatataaaatgaaaagctatactactttttataaaagggcaaactgggctgatgtaaatgttttactttcaactgtgttctttaaaataaatcctacctggtttttaaattttatttttcatgaaaatgctcctttctctacatttattcatcctatatacatcaggctgtaagaccccccccagtcatcattaatacaatgtgttgggattctgtgactggaaaaggtgacaagttggtgactttgacactgcaggtattccattttcatggtttactatgaaaagtcatttttcatattatgtaatatattgttagattaaaaccattgtattaagactttaaaatgtaagcattgtaattctgaaaatacacattttaagaagaaaaaaaaaaagtcgacgcggccgcgaatttaatagtagta

SEQ ID NO: 453229 - DNA, 5459 bp, Homo sapiens
ggatggaggccaaagcgggagagatggggtttcagtgtgttgattatccctagctgtaatgaaagctactgtttgttgactttgcaaggaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctgatagccttctggcaggcattcctcagagagtcaagttcactgtcactaccggccattatacgataaagaatggagacagcctgcagcttagcaatgccgaagccatgctcatcctgtgccaggcggagagcagggctgtggtctactccaacacgagagaacagtcttctgaggccgcgctccggattcagtcctccgacaaggtcacgagcatcagtctgcctgttgcgcctgcgtaccacgtgatcgaatttgaactggaagttctctctttaccttcagccccagcactcggaggggagagtgacatgctggggatggcagagccccacaggaagcataaggacaaacagagaactggccgctgcatggttaccacagaccacaaagtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgtttgattttcttgtatctggttctactcccaggatgaaattatccaactacatatatatttagaggaagaaagtgaaggggaaatttaaaatgtttacggcgcttaattgcctggaaatgaaatgaaatcaaatttatcagtttttttccccctaattacccaaaagatcttttgcaaactatgttacatgaatgcttctgcctctttaagacaaagaagaatgtcacccaaaattgtcatttttttcttaatgttcatcataaaagtcctaaaagagtaactgtaattggatgtttattgtttttatctaaagtaaggtgtatgtgtttgagacaagctggttttgttgataaagagatgttaaataattgtgaagccagatatgcaatgtgtatctaaaaagcaaggaatttgcagccgttttacaaatatctgtggaacatgtaaatactgtcaaatggaaaataaaataagttataatttttgtgaatttcatgggatgtcctatgattggaaaaattataactcttctgattctaatgtggaaattgttgtatttaatctgaaaatgactttacctacaacagttccattgtcagcacagcctaggagggtcagattcctgtattaattactcttagtggagatgccagatatcccatacagaattagcagagaaaatacacacaggcttctattcaaattttctttagtgcttaaaattaagttttaaaatgaaatcagacactgcaggtttgtatataaaatgaaaagctatactactttttataaaagggcaaactgggctgatgtaaatgttttactttcaactgtgttctttaaaataaatcctacctggtttttaaattttatttttcatgaaaatgctcctttctctacatttattcatcctatatacatcaggctgtaagaccccccccagtcatcattaatacaatgtgttgggattctgtgactggaaaaggtgacaagttggtgactttgacactgcaggtattccattttcatggtttactatgaaaagtcatttttcatattatgtaatatattgttagattaaaaccattgtattaagactttaaaatgtaagcattgtaattctgaaaatacacattttaagaagaaaaaaaaaaagtcgacgcggccgcgaatttaatagtagta

SEQ ID NO: 453230 - DNA, 2804 bp, Homo sapiens
aggccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccggggatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacagccaacacagctcagagtccttataagaaactgaaagaagcattatcgtcagtggaagcttttgaaaaacactacttagatttgtcccatgccaccattgaaatgtatacaagcattgggaggattcgatctgctaagtttgttggaaaagatctggcagagttttacatgaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctggtgagtggggtccccagcctttgaggaggcgtgctgctggggcagttctgaggagacctgctgagatgccaggcttctcataagttttagctgtgtctgcctttaagagatattttgggtaacataatggaaattttgcctgggaactagctgactgcctcttttgtttatctgaatgtttgctttcctgtaattgctttttcatgtttaataaacatggtgtatctgaaaataagaaacacagaa

SEQ ID NO: 453231 - DNA, 1864 bp, Homo sapiens
  misc_feature (1856)..(1856): n is a, c, g, or t
aggccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccgggggtataaaatgtcctttccacaactcagtggcctgctggtgatgcttcgattctgtccctcgttagaatcagagtggacgtccctttgccttccatccaggggttatctttggaatgctcgagtgctcattgctgtgaacttataaaatgcccttgggtgttcatctttcttttgcacttttaaataatatcttaagctcctttacaattaaagaattagcacagtgaaaccatacacagagagaaacattggttattgtcctcagtgtttttcgctgatacttattttgatgaaagtgataccacgttatatagctgtttctctgtcgctcctttttgttactcacagcccatcctgggcatctctccaggttagcaggtggggtttggagttgtttttgttacaattggtattcctggcttgattccattacctggtgttggacattgggttcttttatgcttcttgccaccacaagcagtgctgtagtgggcatctctgccaggtgttctttttgagaacccttgtcaccatgtgtgaaggaaggagtaattttgaggagccctggtgtcagcaggagaacctggagggagatgaagtgtggggacggtcagttctagctgtgagcactgtcctcactctggaactcatcagtggcgccgatggatactggctcatagtgcttctgaagatcaggtctggatatctcactctcctgagatgccagtatagacacagaaccaaagcaaagtgtttactaagtaaaaaaataaaataaaaaaacacttctatttcttatattttatgtgtcttttttttttttttttttgaaatggagccactgcactccagcctgggccacagagcaaaactctgtctcaaaaaaanagcacgag

SEQ ID NO: 453232 - DNA, 928 bp, Homo sapiens
  misc_feature (920)..(920): n is a, c, g, or t
aataataataatttaaaaaaactgttttccaggtataaaatgtcctttccacaactcagtggcctgctggtgatgcttcgattctgtccctcgttagaatcagagtggacgtccctttgccttccatccaggggttatctttggaatgctcgagtgctcattgctgtgaacttataaaatgcccttgggtgttcatctttcttttgcacttttaaataatatcttaagctcctttacaattaaagaattagcacagtgaaaccatacacagagagaaacattggttattgtcctcagtgtttttcgctgatacttattttgatgaaagtgataccacgttatatagctgtttctctgtcgctcctttttgttactcacagcccatcctgggcatctctccaggttagcaggtggggtttggagttgtttttgttacaattggtattcctggcttgattccattacctggtgttggacattgggttcttttatgcttcttgccaccacaagcagtgctgtagtgggcatctctgccaggtgttctttttgagaacccttgtcaccatgtgtgaaggaaggagtaattttgaggagccctggtgtcagcaggagaacctggagggagatgaagtgtggggacggtcagttctagctgtgagcactgtcctcactctggaactcatcagtggcgccgatggatactggctcatagtgcttctgaagatcaggtctggatatctcactctcctgagatgccagtatagacacagaaccaaagcaaagtgtttactaagtaaaaaaataaaataaaaaaacacttctatttcttatattttatgtgtcttttttttttttttttttgaaatggagccactgcactccagcctgggccacagagcaaaactctgtctcaaaaaaanagcacgag

SEQ ID NO: 453233 - DNA, 1530 bp, Homo sapiens
  misc_feature (1481)..(1481): n is a, c, g, or t
aggccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccggggatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacaggtncctccatgtataggtggtaaaagtaatgagtatgcgacgcagtgcgcgg

SEQ ID NO: 453234 - DNA, 396 bp, Homo sapiens
acatttcctttctattctctccctttcctgcccagacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaaggtaggtggtctcgaacccatgggctcaagcagtcctcccgccttggcctcccagagtgttgggattacaggtgtgaggcactgcactcagcctatcttgcattttgaatggctcttttacccaggcatcatagcgttacaccctgtgccattagtcatgtgggaaacatggtttcctgagttg

SEQ ID NO: 453235 - DNA, 620 bp, Homo sapiens
tcgtggtgctgtgcatggagggtctttcccagatagtctgttcatgtctttgcaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggtacttgactcattacagaactagacagttccttctctccttccctcctttgttccctccctctctcctcctttctttctaagtaaggcacctctcgtggtaatctcattggcagagtttttaaaaacaaaaaacctggaatatctttaggactagaaaggaagtgtatggaagcagatggggcatgaaaaggacacacacactgccccggggagcctctgggggcaaaagctggagcagtttcagtgacagaataaataaggatagagtcgaggtttaacccatggaataaaattaatatccatgagtctgtatcgatagaaatcatcagttaaataaataaatggaggagaagggtcaactcttcca

SEQ ID NO: 453236 - DNA, 435 bp, Homo sapiens
agctaactgcaaaactgggtgacgtggtttcaaatgcctgattctttgactctaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctggtgagtggggtccccagcctttgaggaggcgtgctgctggggcagttctgaggagacctgctgagatgccaggcttctcataagttttagctgtgtctgcctttaagagatattttgggtaacataatggaaattttgcctgggaactagctgactgcctcttttgtttatctgaatgtttgctttcctgtaattgctttttcatgtttaataaacatggtgtatctgaaaataagaa

SEQ ID NO: 453237 - DNA, 6786 bp, Homo sapiens
catgcataccattacattatttgttgttctatttcccctcttctgatgaatgctgtttagttgttttctcagtgacttcaaacaattgtttacaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccggggatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacagccaacacagctcagagtccttataagaaactgaaagaagcattatcgtcagtggaagcttttgaaaaacactacttagatttgtcccatgccaccattgaaatgtatacaagcattgggaggattcgatctgctaagtttgttggaaaagatctggcagagttttacatgaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctgatagccttctggcaggcattcctcagagagtcaagttcactgtcactaccggccattatacgataaagaatggagacagcctgcagcttagcaatgccgaagccatgctcatcctgtgccaggcggagagcagggctgtggtctactccaacacgagagaacagtcttctgaggccgcgctccggattcagtcctccgacaaggtcacgagcatcagtctgcctgttgcgcctgcgtaccacgtgatcgaatttgaactggaagttctctctttaccttcagccccagcactcggaggggagagtgacatgctggggatggcagagccccacaggaagcataaggacaaacagagaactggccgctgcatggttaccacagaccacaaagtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgtttgattttcttgtatctggttctactcccaggatgaaattatccaactacatatatatttagaggaagaaagtgaaggggaaatttaaaatgtttacggcgcttaattgcctggaaatgaaatgaaatcaaatttatcagtttttttccccctaattacccaaaagatcttttgcaaactatgttacatgaatgcttctgcctctttaagacaaagaagaatgtcacccaaaattgtcatttttttcttaatgttcatcataaaagtcctaaaagagtaactgtaattggatgtttattgtttttatctaaagtaaggtgtatgtgtttgagacaagctggttttgttgataaagagatgttaaataattgtgaagccagatatgcaatgtgtatctaaaaagcaaggaatttgcagccgttttacaaatatctgtggaacatgtaaatactgtcaaatggaaaataaaataagttataatttttgtgaatttcatgggatgtcctatgattggaaaaattataactcttctgattctaatgtggaaattgttgtatttaatctgaaaatgactttacctacaacagttccattgtcagcacagcctaggagggtcagattcctgtattaattactcttagtggagatgccagatatcccatacagaattagcagagaaaatacacacaggcttctattcaaattttctttagtgcttaaaattaagttttaaaatgaaatcagacactgcaggtttgtatataaaatgaaaagctatactactttttataaaagggcaaactgggctgatgtaaatgttttactttcaactgtgttctttaaaataaatcctacctggtttttaaattttatttttcatgaaaatgctcctttctctacatttattcatcctatatacatcaggctgtaagaccccccccagtcatcattaatacaatgtgttgggattctgtgactggaaaaggtgacaagttggtgactttgacactgcaggtattccattttcatggtttactatgaaaagtcatttttcatattatgtaatatattgttagattaaaaccattgtattaagactttaaaatgtaagcattgtaattctgaaaatacacattttaagaagaaaaaaaaaaagtcgacgcggccgcgaatttaatagtagta

SEQ ID NO: 453238 - DNA, 4253 bp, Homo sapiens
ctgggcagcagtggtggtggctgtgctgtccgtcggcgagtggtctgagagtgtctttgtgcttcctcctcaggtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttggtggccctggcccccttgccagattccagctggccgtcagtgctcgcgtgtctctctgaagaggctctgcggttctggtccctgtgcctgagctccaggtgccgccagacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgtttgattttcttgtatctggttctactcccaggatgaaattatccaactacatatatatttagaggaagaaagtgaaggggaaatttaaaatgtttacggcgcttaattgcctggaaatgaaatgaaatcaaatttatcagtttttttccccctaattacccaaaagatcttttgcaaactatgttacatgaatgcttctgcctctttaagacaaagaagaatgtcacccaaaattgtcatttttttcttaatgttcatcataaaagtcctaaaagagtaactgtaattggatgtttattgtttttatctaaagtaaggtgtatgtgtttgagacaagctggttttgttgataaagagatgttaaataattgtgaagccagatatgcaatgtgtatctaaaaagcaaggaatttgcagccgttttacaaatatctgtggaacatgtaaatactgtcaaatggaaaataaaataagttataatttttgtgaatttcatgggatgtcctatgattggaaaaattataactcttctgattctaatgtggaaattgttgtatttaatctgaaaatgactttacctacaacagttccattgtcagcacagcctaggagggtcagattcctgtattaattactcttagtggagatgccagatatcccatacagaattagcagagaaaatacacacaggcttctattcaaattttctttagtgcttaaaattaagttttaaaatgaaatcagacactgcaggtttgtatataaaatgaaaagctatactactttttataaaagggcaaactgggctgatgtaaatgttttactttcaactgtgttctttaaaataaatcctacctggtttttaaattttatttttcatgaaaatgctcctttctctacatttattcatcctatatacatcaggctgtaagaccccccccagtcatcattaatacaatgtgttgggattctgtgactggaaaaggtgacaagttggtgactttgacactgcaggtattccattttcatggtttactatgaaaagtcatttttcatattatgtaatatattgttagattaaaaccattgtattaagactttaaaatgtaagcattgtaattctgaaaatacacattttaagaagaaaaaaaaaaagtcgacgcggccgcgaatttaatagtagta

SEQ ID NO: 453239 - DNA, 2807 bp, Homo sapiens
aggccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccggggatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacagccaacacagctcagagtccttataagaaactgaaagaagcattatcgtcagtggaagcttttgaaaaacactacttagatttgtcccatgccaccattgaaatgtatacaagcattgggaggattcgatctgctaagtttgttggaaaagatctggcagagttttacatgaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggtatgcgttcagggtgggaacttgactttcaagtttgtaaagcagggccgtggagcttacaagaactgtctggagtgtgctgtgaattgagtagagtcctttgttctcctaaccctgtttttgtctctgtccttatacaaaaatacactgatgttttctttcgtgtttaaaacacaaaacacaaaaacaacacaacaaacacaaaaaacacacacaaaacaacaaaaccaaaaaaaacaagacagaaacaacgaaaagataatgacagactagacaaagagagcaaatagaagaatagtataaacaaagaaaagacgcctagagcaacgagggagatataaggatgacggggcgtgaggtggcgcgccccctgtccttcaacaggtttgtg

SEQ ID NO: 453240 - DNA, 423 bp, Homo sapiens
  misc_feature (415)..(415): n is a, c, g, or t
gcggccgcctactactactactactgctcgaattcaagcttctaacgatgtacggggacatgtgtgaaggaaggagtaattttgaggagccctggtgtcagcaggagaacctggagggagatgaagtgtggggacggtcagttctagctgtgagcactgtcctcactctggaactcatcagtggcgccgatggatactggctcatagtgcttctgaagatcaggtctggatatctcactctcctgagatgccagtatagacacagaaccaaagcaaagtgtttactaagtaaaaaaataaaataaaaaaacacttctatttcttatattttatgtgtcttttttttttttttttttgaaatggagccactgcactccagcctgggccacagagcaaaactctgtctcaaaaaaanagcacgag

SEQ ID NO: 453241 - DNA, 416 bp, Homo sapiens
gccgaggccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgagtgcccggaggcggggagggcgcggcggtcgttgggcgggcccgggccctggcgttatgcacccggcgcccccagaccttcagcccccggcgcgctccgggctgggccgcttcctggaggtgtgaccagggctgcggctgaggcggggccctctgacttttcg

SEQ ID NO: 453242 - DNA, 8073 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgtgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggtggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttctttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagattggacatgttccatagccttgctggggaagggcccactgccaactccctctgccccagccccacccttggccatctccctttgggaactagggggctgctggtgggaaatgggagccagggcagatgtatgcattcctttatgtccctgtaaatgtgggactacaagaagaggagctgcctgagtggtactttctcttcctggtaatcctctggcccagccttatggcagaatagaggtatttttaggctatttttgtaatatggcttctggtcaaaatccctgtgtagctgaattcccaagccctgcattgtacagccccccactcccctcaccacctaataaaggaatagttaacactca

SEQ ID NO: 453243 - DNA, 5709 bp, Homo sapiens
caggaattagatcaggcacaattagcagcgtttgcttggcagcttaaagggaccttttggttttcccaacatcctgcccttgccacataggtgaggtttccagataaaggaggggacgaggccacagaaggggatggatttagattcctctgaccaaatgcaccccatcccagttgaacctggtttcctcctgaattcttctcaatccaaggcatatcccagtcagactgggctaatgggggcaaggtaggtgaccagaccgccttcctcctgtccgcagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggtggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttctttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagattggacatgttccatagccttgctggggaagggcccactgccaactccctctgccccagccccacccttggccatctccctttgggaactagggggctgctggtgggaaatgggagccagggcagatgtatgcattcctttatgtccctgtaaatgtgggactacaagaagaggagctgcctgagtggtactttctcttcctggtaatcctctggcccagccttatggcagaatagaggtatttttaggctatttttgtaatatggcttctggtcaaaatccctgtgtagctgaattcccaagccctgcattgtacagccccccactcccctcaccacctaataaaggaatagttaacactca

SEQ ID NO: 453244 - DNA, 4831 bp, Homo sapiens
tctgcccacctcggcctcccaaagtgctgggattacctactggtagtgcgctgaacatctgtgtgtgtccttttgtgctggggttctttgcgtcttcatgggtatgtccaggtgggtctgtgtcccactaagctgagtgggtccctctcttaccccactgaagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggtggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttctttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagattggacatgttccatagccttgctggggaagggcccactgccaactccctctgccccagccccacccttggccatctccctttgggaactagggggctgctggtgggaaatgggagccagggcagatgtatgcattcctttatgtccctgtaaatgtgggactacaagaagaggagctgcctgagtggtactttctcttcctggtaatcctctggcccagccttatggcagaatagaggtatttttaggctatttttgtaatatggcttctggtcaaaatccctgtgtagctgaattcccaagccctgcattgtacagccccccactcccctcaccacctaataaaggaatagttaacactca

SEQ ID NO: 453245 - DNA, 8092 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggtggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttctttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagattggacatgttccatagccttgctggggaagggcccactgccaactccctctgccccagccccacccttggccatctccctttgggaactagggggctgctggtgggaaatgggagccagggcagatgtatgcattcctttatgtccctgtaaatgtgggactacaagaagaggagctgcctgagtggtactttctcttcctggtaatcctctggcccagccttatggcagaatagaggtatttttaggctatttttgtaatatggcttctggtcaaaatccctgtgtagctgaattcccaagccctgcattgtacagccccccactcccctcaccacctaataaaggaatagttaacactcatatgctgtacagcataaactattagtgggagtagagtttgaagtccttgagagaggattatgatgcgactgtgagtgcgttcgtagtttgagtttgctaggcagaatagtaatgaggatgtaagtccgtgggcgattatgagaatgactgcgccggtgaagcttcagggggtttt

SEQ ID NO: 453246 - DNA, 5966 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggtgagccccagcccttggtccactgggtgtcagcagtggcacagtgccattgcaatccagcctgggcaacagagtgagactctctcaaaaaacaaaacaaaataaaaccccaaacattggattaaaatata

SEQ ID NO: 453247 - DNA, 3777 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccaggtaggtgtgggtggcggc

SEQ ID NO: 453248 - DNA, 2782 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgtgatcaggacatcaatgactgtgaccccagtgagtgcaggggagctcttgggggtgctgctctggggaacacagtcattaagcttgaactgtgtgcctggcactgtgctgtcatttcatcttcacagttatcttacttttcccgttttatttatatggaaactgagg

SEQ ID NO: 453249 - DNA, 7917 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggtggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttctttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagattggacatgttccatagccttgctggggaagggcccactgccaactccctctgccccagccccacccttggccatctccctttgggaactagggggctgctggtgggaaatgggagccagggcagatgtatgcattcctttatgtccctgtaaatgtgggactacaagaagaggagctgcctgagtggtactttctcttcctggtaatcctctggcccagccttatggcagaatagaggtatttttaggctatttttgtaatatggcttctggtcaaaatccctgtgtagctgaattcccaagccctgcattgtacagccccccactcccctcaccacctaataaaggaatagttaacactca

SEQ ID NO: 453250 - DNA, 4412 bp, Homo sapiens
  misc_feature (14)..(15): n is a, c, g, or t
  misc_feature (110)..(110): n is a, c, g, or t
agtgtcgctcaggnntgcctgccacgcggcacacacccgggactgcagcaggaccagcgaggttttttttcccccccccgggttttttttggggcccccccctttttttnttggggtccatgctggcttctcagggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggtggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttctttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagattggacatgttccatagccttgctggggaagggcccactgccaactccctctgccccagccccacccttggccatctccctttgggaactagggggctgctggtgggaaatgggagccagggcagatgtatgcattcctttatgtccctgtaaatgtgggactacaagaagaggagctgcctgagtggtactttctcttcctggtaatcctctggcccagccttatggcagaatagaggtatttttaggctatttttgtaatatggcttctggtcaaaatccctgtgtagctgaattcccaagccctgcattgtacagccccccactcccctcaccacctaataaaggaatagttaacactca

SEQ ID NO: 453251 - DNA, 7301 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggtggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgcctcccggattcaatgtgattctccattcctcacgcctcccgatgtagctcgggaacggagaatccacttggaggtacctgacgctcgcaattctgtaata

SEQ ID NO: 453252 - DNA, 5727 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcccgcacatccgtactggcccgcacatccgatggcccgcacaatccgtactgcccg

SEQ ID NO: 453253 - DNA, 3099 bp, Homo sapiens
  misc_feature (1)..(1): n is a, c, g, or t
ntttttacctaagcaagcctgggcaatggcgggcgtccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcggatgggagtgacccgattttccaggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453254 - DNA, 3624 bp, Homo sapiens
ctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc
